United States Patent 12,442,020 (MATERIALS AND METHODS FOR TREATMENT OF PAIN RELATED DISORDERS) - sequence listing, part 6

SEQ ID NO: 64907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgtcaggtgttgtgatat

SEQ ID NO: 64908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacaccaactatgtgtcagg

SEQ ID NO: 64909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacaccaactatgtgtcag

SEQ ID NO: 64910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaacaccaactatgtgtca

SEQ ID NO: 64911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaaacattttaaacacca

SEQ ID NO: 64912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaaaacattttaaacacc

SEQ ID NO: 64913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaaaaacattttaaacac

SEQ ID NO: 64914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagaaaaacattttaaaca

SEQ ID NO: 64915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttagaaaaacattttaaac

SEQ ID NO: 64916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acattttttagaaaaacatt

SEQ ID NO: 64917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcacattttttagaaaaac

SEQ ID NO: 64918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catcattactcacatttttt

SEQ ID NO: 64919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagacccatgattccatca

SEQ ID NO: 64920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagagacccatgattccat

SEQ ID NO: 64921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcagagacccatgattcca

SEQ ID NO: 64922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcagagacccatgattcc

SEQ ID NO: 64923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctttctcagagacccatga

SEQ ID NO: 64924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcagaccaataggtgcctg

SEQ ID NO: 64925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatcagaccaataggtgcc

SEQ ID NO: 64926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcatcagaccaataggtgc

SEQ ID NO: 64927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttctcatcagaccaatag

SEQ ID NO: 64928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaactggcttctcatcaga

SEQ ID NO: 64929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccaactggcttctcatcag

SEQ ID NO: 64930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcccaactggcttctcatca

SEQ ID NO: 64931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctttcccaactggcttctc

SEQ ID NO: 64932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctttcccaactggcttct

SEQ ID NO: 64933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagctttcccaactggcttc

SEQ ID NO: 64934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttagctttcccaactggct

SEQ ID NO: 64935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggctctttagctttcccaac

SEQ ID NO: 64936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggctctttagctttcccaa

SEQ ID NO: 64937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtccttaggctctttagct

SEQ ID NO: 64938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtccttaggctctttagc

SEQ ID NO: 64939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgagtccttaggctcttt

SEQ ID NO: 64940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttgagtccttaggctctt

SEQ ID NO: 64941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtcagcttgtttgagtcc

SEQ ID NO: 64942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggcatattgtagtcagctt

SEQ ID NO: 64943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggcatattgtagtcagct

SEQ ID NO: 64944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggataaatgaaataatga

SEQ ID NO: 64945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaggataaatgaaataatg

SEQ ID NO: 64946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaggataaatgaaataat

SEQ ID NO: 64947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttgaaggataaatgaaat

SEQ ID NO: 64948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgccgcagggctattttga

SEQ ID NO: 64949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcatgccgcagggctattt

SEQ ID NO: 64950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcatgccgcagggctatt

SEQ ID NO: 64951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accatgcaaaaagagacatt

SEQ ID NO: 64952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaccatgcaaaaagagac

SEQ ID NO: 64953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaaccatgcaaaaagaga

SEQ ID NO: 64954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttgttaaccatgcaaaa

SEQ ID NO: 64955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttacatttgttaaccatgc

SEQ ID NO: 64956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttacatttgttaaccatg

SEQ ID NO: 64957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttagttacatttgttaacc

SEQ ID NO: 64958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaggcaaatgtctatttag

SEQ ID NO: 64959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaggcaaatgtctattta

SEQ ID NO: 64960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagaggcaaatgtctattt

SEQ ID NO: 64961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatattttgagaggcaaat

SEQ ID NO: 64962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtatattttgagaggcaaa

SEQ ID NO: 64963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgcaggagaatagtttag

SEQ ID NO: 64964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggtgaattggatgcagga

SEQ ID NO: 64965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattacaggtgaattggatg

SEQ ID NO: 64966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgtattacaggtgaattg

SEQ ID NO: 64967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctgtattacaggtgaatt

SEQ ID NO: 64968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatctgtattacaggtgaat

SEQ ID NO: 64969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttatctgtattacaggtga

SEQ ID NO: 64970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctttatctgtattacagg

SEQ ID NO: 64971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttctttatctgtattacag

SEQ ID NO: 64972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttctttatctgtattaca

SEQ ID NO: 64973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgttctttatctgtatta

SEQ ID NO: 64974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctttgttctttatctgta

SEQ ID NO: 64975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctctttgttctttatctgt

SEQ ID NO: 64976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgctctttgttctttatc

SEQ ID NO: 64977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtttgctctttgttcttta

SEQ ID NO: 64978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actctgtttgctctttgttc

SEQ ID NO: 64979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactctgtttgctctttgtt

SEQ ID NO: 64980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttaactctgtttgctcttt

SEQ ID NO: 64981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agccagcccactatttaact

SEQ ID NO: 64982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgattaagccagcccact

SEQ ID NO: 64983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtgattaagccagcccac

SEQ ID NO: 64984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcagtgattaagccagcc

SEQ ID NO: 64985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttcagtgattaagccagc

SEQ ID NO: 64986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaaccacttccttcagtg

SEQ ID NO: 64987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccctacaaaaccacttcctt

SEQ ID NO: 64988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccctacaaaaccacttcct

SEQ ID NO: 64989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcccctacaaaaccacttcc

SEQ ID NO: 64990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcacaactttcccctacaaa

SEQ ID NO: 64991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatctatcacaactttccc

SEQ ID NO: 64992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagaatgttacaatctatc

SEQ ID NO: 64993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcattaatagaatgttaca

SEQ ID NO: 64994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagcattaatagaatgttac

SEQ ID NO: 64995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagcattaatagaatgtta

SEQ ID NO: 64996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagcattaatagaatgtt

SEQ ID NO: 64997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagcattaatagaatgt

SEQ ID NO: 64998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttttgagcattaataga

SEQ ID NO: 64999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattttttgagcattaatag

SEQ ID NO: 65000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttaattttttgagcatta

SEQ ID NO: 65001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acattaacttaattttttga

SEQ ID NO: 65002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgacattaacttaatttt

SEQ ID NO: 65003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaattcattgacattaactt

SEQ ID NO: 65004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcagaaaggtggtattaga

SEQ ID NO: 65005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgcagaaaggtggtattag

SEQ ID NO: 65006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgcagaaaggtggtatta

SEQ ID NO: 65007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttgtgcagaaaggtggt

SEQ ID NO: 65008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattttgtgcagaaaggtgg

SEQ ID NO: 65009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagtttcattttgtgcaga

SEQ ID NO: 65010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaattacaagtttcatttt

SEQ ID NO: 65011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caagttgaaaattacaagtt

SEQ ID NO: 65012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctacaagttgaaaattaca

SEQ ID NO: 65013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatctacaagttgaaaatta

SEQ ID NO: 65014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaatattctatctacaag

SEQ ID NO: 65015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataagcacaattcaaaaata

SEQ ID NO: 65016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacaaaaaagttcataagca

SEQ ID NO: 65017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagtataaaagaaagatca

SEQ ID NO: 65018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaagtataaaagaaagatc

SEQ ID NO: 65019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccagtgtataacggtttcc

SEQ ID NO: 65020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attatccagtgtataacggt

SEQ ID NO: 65021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattatccagtgtataacgg

SEQ ID NO: 65022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattatccagtgtataacg

SEQ ID NO: 65023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttaattatccagtgtata

SEQ ID NO: 65024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctattttaattatccagtgt

SEQ ID NO: 65025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctattttaattatccagt

SEQ ID NO: 65026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caatctctgctattttaatt

SEQ ID NO: 65027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgactgcaatctctgctatt

SEQ ID NO: 65028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attatgactgcaatctctgc

SEQ ID NO: 65029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaacctaattatgactgca

SEQ ID NO: 65030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccctacaaacctaattatg

SEQ ID NO: 65031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatccctacaaacctaatt

SEQ ID NO: 65032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgttatccctacaaacct

SEQ ID NO: 65033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cactgttatccctacaaacc

SEQ ID NO: 65034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaaatcttcactgttatcc

SEQ ID NO: 65035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcctaccaaatcttcactg

SEQ ID NO: 65036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcctaccaaatcttcact

SEQ ID NO: 65037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagcctaccaaatcttcac

SEQ ID NO: 65038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagatctttcagcctaccaa

SEQ ID NO: 65039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagtgaacattagagatctt

SEQ ID NO: 65040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accagcctcaagtgaacatt

SEQ ID NO: 65041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaccagcctcaagtgaacat

SEQ ID NO: 65042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaccagcctcaagtgaaca

SEQ ID NO: 65043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggttttaaccagcctcaagt

SEQ ID NO: 65044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggttttaaccagcctcaag

SEQ ID NO: 65045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caggatggggataagaaact

SEQ ID NO: 65046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtcagaaactccaggatgg

SEQ ID NO: 65047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgagtcagaaactccagga

SEQ ID NO: 65048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accccagacctactgagtca

SEQ ID NO: 65049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatctcaccccagacctact

SEQ ID NO: 65050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggatctcaccccagacctac

SEQ ID NO: 65051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggatctcaccccagacct

SEQ ID NO: 65052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatcaaaaaaaaaaaaaaaa

SEQ ID NO: 65053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtatcaaaaaaaaaaaaaa

SEQ ID NO: 65054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggaacagagcaagactctg

SEQ ID NO: 65055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcctggggaacagagcaa

SEQ ID NO: 65056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactccagcctggggaacag

SEQ ID NO: 65057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtgagccgagatcatgca

SEQ ID NO: 65058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacccgggaggcagaggttg

SEQ ID NO: 65059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaacccgggaggcagaggtt

SEQ ID NO: 65060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcagaagaatcgcttgaa

SEQ ID NO: 65061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggaggctgaggcagaagaa

SEQ ID NO: 65062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctagggaggctgaggcagaa

SEQ ID NO: 65063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agctactagggaggctgagg

SEQ ID NO: 65064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagtctcagctactagggag

SEQ ID NO: 65065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acctgtagtctcagctacta

SEQ ID NO: 65066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccgggcatagtggtgctca

SEQ ID NO: 65067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatgcaaaaaattacccg

SEQ ID NO: 65068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaaaatgcaaaaaattac

SEQ ID NO: 65069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactaaaaatgcaaaaaatt

SEQ ID NO: 65070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccaatatggtgaaacccca

SEQ ID NO: 65071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gagaccagcctggccaatat

SEQ ID NO: 65072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagacggacggatcatga

SEQ ID NO: 65073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaaaagacggacggatca

SEQ ID NO: 65074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attaaaaagacggacggatc

SEQ ID NO: 65075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaacttattaaaaagacgg

SEQ ID NO: 65076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctacaaacttattaaaaag

SEQ ID NO: 65077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcattatctacaaacttatt

SEQ ID NO: 65078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttagcattatctacaaactt

SEQ ID NO: 65079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
accagctattagcattatct

SEQ ID NO: 65080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgaccagctattagcatta

SEQ ID NO: 65081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgaccagctattagcatt

SEQ ID NO: 65082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgtggtttactgaccagc

SEQ ID NO: 65083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtgtggtttactgaccag

SEQ ID NO: 65084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagtgtggtttactgacca

SEQ ID NO: 65085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atactttaagtgtggtttac

SEQ ID NO: 65086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgatactttaagtgtggtt

SEQ ID NO: 65087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgatactttaagtgtggt

SEQ ID NO: 65088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtccagcttactgatacttt

SEQ ID NO: 65089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acacggagattagtccagct

SEQ ID NO: 65090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacacggagattagtccagc

SEQ ID NO: 65091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcaatttaacacggagatt

SEQ ID NO: 65092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgagcaatttaacacggaga

SEQ ID NO: 65093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgagcaatttaacacgga

SEQ ID NO: 65094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctgagcaatttaacacgg

SEQ ID NO: 65095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttctctgagcaatttaac

SEQ ID NO: 65096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accttctctgagcaatttaa

SEQ ID NO: 65097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccttaccttctctgagcaat

SEQ ID NO: 65098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctaccttaccttctctgag

SEQ ID NO: 65099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctccctaccttaccttctc

SEQ ID NO: 65100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actgcctccctaccttacct

SEQ ID NO: 65101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aactgcctccctaccttacc

SEQ ID NO: 65102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttaactgcctccctacctt

SEQ ID NO: 65103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttaactgcctccctacct

SEQ ID NO: 65104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttacttaactgcctcccta

SEQ ID NO: 65105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttacttaactgcctccct

SEQ ID NO: 65106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtttacttaactgcctc

SEQ ID NO: 65107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttgtttacttaactgcct

SEQ ID NO: 65108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttatttgtttacttaactg

SEQ ID NO: 65109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttatttgtttacttaact

SEQ ID NO: 65110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacttatttgtttacttaac

SEQ ID NO: 65111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattttacttatttgtttac

SEQ ID NO: 65112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattgtattttacttatttg

SEQ ID NO: 65113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attatattgtattttactta

SEQ ID NO: 65114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatcctcattatattgtat

SEQ ID NO: 65115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agacacctaaaatcctcatt

SEQ ID NO: 65116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcagacacctaaaatcctc

SEQ ID NO: 65117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttcagacacctaaaatcc

SEQ ID NO: 65118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgttcagacacctaaaat

SEQ ID NO: 65119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctgttcagacacctaaa

SEQ ID NO: 65120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctctctgttcagacaccta

SEQ ID NO: 65121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatattctctctctgttcag

SEQ ID NO: 65122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccgtccaccaggagacata

SEQ ID NO: 65123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtccgtccaccaggagacat

SEQ ID NO: 65124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccttgtccgtccaccaggag

SEQ ID NO: 65125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagttgccttgtccgtccac

SEQ ID NO: 65126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagttgccttgtccgtcca

SEQ ID NO: 65127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatttaaagttgccttgtcc

SEQ ID NO: 65128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggctcaatttaaagttgcc

SEQ ID NO: 65129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggctcaatttaaagttgc

SEQ ID NO: 65130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaggctcaatttaaagttg

SEQ ID NO: 65131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcctttaaggctcaatttaa

SEQ ID NO: 65132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctgtcctttaaggctcaat

SEQ ID NO: 65133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatagcagacaaacacctat

SEQ ID NO: 65134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatagcagacaaacaccta

SEQ ID NO: 65135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acccgtttgtatagcagaca

SEQ ID NO: 65136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcccgaccctaacccgtttg

SEQ ID NO: 65137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccctgtcccgaccctaaccc

SEQ ID NO: 65138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccctgccctgtcccgaccct

SEQ ID NO: 65139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccctgccctgtcccgaccc

SEQ ID NO: 65140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatgcttcccctgccctgt

SEQ ID NO: 65141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaatgcttcccctgccct

SEQ ID NO: 65142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctggaatgcttcccctgc

SEQ ID NO: 65143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttctggaatgcttcccct

SEQ ID NO: 65144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcctctgttctggaatgct

SEQ ID NO: 65145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgcctctgttctggaatgc

SEQ ID NO: 65146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgcctctgttctggaatg

SEQ ID NO: 65147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttatgcctctgttctgga

SEQ ID NO: 65148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctattttatgcctctgttct

SEQ ID NO: 65149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacctgctattttatgcctc

SEQ ID NO: 65150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacctgctattttatgcct

SEQ ID NO: 65151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagatttatacctgctattt

SEQ ID NO: 65152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccagatttatacctgctat

SEQ ID NO: 65153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctccagatttatacctgcta

SEQ ID NO: 65154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctccagatttatacctgc

SEQ ID NO: 65155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctccagatttatacctg

SEQ ID NO: 65156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatttcttctccagattta

SEQ ID NO: 65157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaaatttcttctccagatt

SEQ ID NO: 65158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctaaaatttcttctccag

SEQ ID NO: 65159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtactcctctaaaatttctt

SEQ ID NO: 65160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgtgttggtactcctctaa

SEQ ID NO: 65161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtccatatcctcatgtgttg

SEQ ID NO: 65162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taattagtccatatcctcat

SEQ ID NO: 65163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtaattagtccatatcctc

SEQ ID NO: 65164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtaattagtccatatcct

SEQ ID NO: 65165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtaattagtccatatcc

SEQ ID NO: 65166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttctgtaattagtccata

SEQ ID NO: 65167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattttctgtaattagtcca

SEQ ID NO: 65168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taacacacatggaggacaac

SEQ ID NO: 65169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaacacacatggaggacaa

SEQ ID NO: 65170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtaacacacatggaggaca

SEQ ID NO: 65171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaccagcaactttgtaacac

SEQ ID NO: 65172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattaaaccagcaactttgt

SEQ ID NO: 65173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggattgtattaaaccagca

SEQ ID NO: 65174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggattgtattaaaccagc

SEQ ID NO: 65175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaggattgtattaaaccag

SEQ ID NO: 65176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctttaaggattgtattaaa

SEQ ID NO: 65177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccataacctagctttaagga

SEQ ID NO: 65178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatgaataacaactaccat

SEQ ID NO: 65179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcagagacaaacaagttata

SEQ ID NO: 65180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aattagcagagacaaacaag

SEQ ID NO: 65181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaagatactcaattagcag

SEQ ID NO: 65182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagagtgcctgaaaagatac

SEQ ID NO: 65183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggctgcagagtgcctgaaaa

SEQ ID NO: 65184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggctgcagagtgcctgaaa

SEQ ID NO: 65185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacttaggctgcagagtgcc

SEQ ID NO: 65186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacttaggctgcagagtgc

SEQ ID NO: 65187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttgcacttaggctgcaga

SEQ ID NO: 65188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatttgcacttaggctgcag

SEQ ID NO: 65189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttaatttgcacttaggctg

SEQ ID NO: 65190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttaatttgcacttaggct

SEQ ID NO: 65191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagagtttacttaatttgc

SEQ ID NO: 65192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagctcagagagtttactta

SEQ ID NO: 65193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaaactaaagctcagaga

SEQ ID NO: 65194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaaaactaaagctcagag

SEQ ID NO: 65195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttgagaaaactaaagct

SEQ ID NO: 65196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattatatttgagaaaacta

SEQ ID NO: 65197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taactaaattatatttgaga

SEQ ID NO: 65198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaagtaagtggaattataa

SEQ ID NO: 65199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataacattgcaaagtaag

SEQ ID NO: 65200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaataacattgcaaagtaa

SEQ ID NO: 65201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaataacattgcaaagta

SEQ ID NO: 65202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctttaaaataacattgca

SEQ ID NO: 65203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacctttaaaataacattgc

SEQ ID NO: 65204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttcacctttaaaataaca

SEQ ID NO: 65205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttcacctttaaaataac

SEQ ID NO: 65206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaagataggtaagtgaga

SEQ ID NO: 65207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtaaggagcattagaaaag

SEQ ID NO: 65208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctgggtaaggagcattaga

SEQ ID NO: 65209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaactacctgggtaagga

SEQ ID NO: 65210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaaactacctgggtaagg

SEQ ID NO: 65211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaagaaactacctgggta

SEQ ID NO: 65212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttaagaaactacctgggt

SEQ ID NO: 65213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaataatatttgtttaagaa

SEQ ID NO: 65214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcaggtgttcaaataata

SEQ ID NO: 65215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatcaggtgttcaaataat

SEQ ID NO: 65216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttatatcaggtgttcaaat

SEQ ID NO: 65217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atacataagtaatcaaggac

SEQ ID NO: 65218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatacataagtaatcaagg

SEQ ID NO: 65219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acatcatctctcatacataa

SEQ ID NO: 65220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaacatcatctctcataca

SEQ ID NO: 65221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcctaacatcatctctcat

SEQ ID NO: 65222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgttcctaacatcatctct

SEQ ID NO: 65223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggaagtccaagtgaaagggg

SEQ ID NO: 65224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgctaggaagtccaagtgaa

SEQ ID NO: 65225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgtgctaggaagtccaag

SEQ ID NO: 65226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctgtgctaggaagtccaa

SEQ ID NO: 65227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatggaaatcttccctgtgc

SEQ ID NO: 65228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atattaaatggaaatcttcc

SEQ ID NO: 65229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catattaaatggaaatcttc

SEQ ID NO: 65230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatattaaatggaaatctt

SEQ ID NO: 65231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatattaaatggaaatct

SEQ ID NO: 65232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcatattaaatggaaatc

SEQ ID NO: 65233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttcatattaaatggaaat

SEQ ID NO: 65234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaaacaatagaatgatcca

SEQ ID NO: 65235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atattgtcaaacaatagaat

SEQ ID NO: 65236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctaatattgtcaaacaata

SEQ ID NO: 65237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctaatattgtcaaacaat

SEQ ID NO: 65238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatctaatattgtcaaacaa

SEQ ID NO: 65239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctttatctaatattgtcaa

SEQ ID NO: 65240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcacagtaatcctgccttt

SEQ ID NO: 65241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaagggaataagttaatca

SEQ ID NO: 65242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaagggaataagttaatc

SEQ ID NO: 65243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaacaagggaataagtta

SEQ ID NO: 65244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgcatattgtttaacaag

SEQ ID NO: 65245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtgcatattgtttaacaa

SEQ ID NO: 65246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatatatatatatacaca

SEQ ID NO: 65247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatatatatatatatataca

SEQ ID NO: 65248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctatatatatatatatata

SEQ ID NO: 65249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctatatatatatatata

SEQ ID NO: 65250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctatatatatatata

SEQ ID NO: 65251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctctatatatatata

SEQ ID NO: 65252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctctctatatatata

SEQ ID NO: 65253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatatatatgcatactctc

SEQ ID NO: 65254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacatattagtatatatatg

SEQ ID NO: 65255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtacatattagtatatat

SEQ ID NO: 65256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgtacatattagtatata

SEQ ID NO: 65257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttactgtacatattagta

SEQ ID NO: 65258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttactgtacatattagt

SEQ ID NO: 65259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcatttactgtacatatt

SEQ ID NO: 65260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatataaaatatgcatatat

SEQ ID NO: 65261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatatacagaatatgaaag

SEQ ID NO: 65262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatattaatatatacagaat

SEQ ID NO: 65263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatatattaatatatacag

SEQ ID NO: 65264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatatactattatatatta

SEQ ID NO: 65265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attagtatatactattatat

SEQ ID NO: 65266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaaagtataatactaatta

SEQ ID NO: 65267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaaaaaagtataatactaa

SEQ ID NO: 65268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtatattactaaaaaagtat

SEQ ID NO: 65269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatatactagtatattact

SEQ ID NO: 65270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attagtatatactagtatat

SEQ ID NO: 65271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatagtataatactcatt

SEQ ID NO: 65272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaaaaatagtataatactc

SEQ ID NO: 65273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatagtatattactaaaaat

SEQ ID NO: 65274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaaatagtatattactaa

SEQ ID NO: 65275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagcattaattaaatagtat

SEQ ID NO: 65276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attatagcattaattaaata

SEQ ID NO: 65277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatataaatactaattata

SEQ ID NO: 65278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atggtatatatgcatactaa

SEQ ID NO: 65279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatactaatggtatatat

SEQ ID NO: 65280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atagtatatatgcatattat

SEQ ID NO: 65281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catatactaatagtatatat

SEQ ID NO: 65282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atagtatatatatgcatatt

SEQ ID NO: 65283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatacactaatagtatatat

SEQ ID NO: 65284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatagtatgcatatatgg

SEQ ID NO: 65285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatacagtatgcatatatac

SEQ ID NO: 65286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catactatatacagtatgca

SEQ ID NO: 65287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatactatatacagtatgc

SEQ ID NO: 65288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatagtatgcatttacatac

SEQ ID NO: 65289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtatgtgtgtgtacatata

SEQ ID NO: 65290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtatgtgtgtgtacatat

SEQ ID NO: 65291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttatgtatgtgtgtgtaca

SEQ ID NO: 65292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataaatacataggctgttt

SEQ ID NO: 65293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acataaatacataggctgtt

SEQ ID NO: 65294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttacataaatacataggct

SEQ ID NO: 65295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttacataaatacatagg

SEQ ID NO: 65296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtttacataaatacatag

SEQ ID NO: 65297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttctgtttacataaataca

SEQ ID NO: 65298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagttgtttctgtttacat

SEQ ID NO: 65299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatataaaaacaatgggta

SEQ ID NO: 65300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatataaaaacaatgggt

SEQ ID NO: 65301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggggtttaaaatataaaa

SEQ ID NO: 65302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatggggtttaaaatataaa

SEQ ID NO: 65303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatggggtttaaaatataa

SEQ ID NO: 65304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatggggtttaaaatata

SEQ ID NO: 65305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaatggggtttaaaatat

SEQ ID NO: 65306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttaatggggtttaaaa

SEQ ID NO: 65307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttttaatggggtttaaa

SEQ ID NO: 65308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattttttaatggggttta

SEQ ID NO: 65309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatgttcttattttttaat

SEQ ID NO: 65310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatgttcttattttttaa

SEQ ID NO: 65311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tataatgttcttatttttta

SEQ ID NO: 65312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactttataatgttcttatt

SEQ ID NO: 65313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggaatgagggtaagaaaa

SEQ ID NO: 65314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaggaatgagggtaagaaa

SEQ ID NO: 65315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatttgaaggaatgagggta

SEQ ID NO: 65316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctagatttgaaggaatgag

SEQ ID NO: 65317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctagatttgaaggaatga

SEQ ID NO: 65318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agagccttatctagatttga

SEQ ID NO: 65319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagagccttatctagattt

SEQ ID NO: 65320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agacctctaagagccttatc

SEQ ID NO: 65321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagacctctaagagccttat

SEQ ID NO: 65322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagacctctaagagcctta

SEQ ID NO: 65323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agagctttaagacctctaag

SEQ ID NO: 65324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggacactgagagctttaaga

SEQ ID NO: 65325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cggacactgagagctttaag

SEQ ID NO: 65326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcccttcggacactgaga

SEQ ID NO: 65327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccccattaaatcccttcgg

SEQ ID NO: 65328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggccccattaaatcccttcg

SEQ ID NO: 65329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agatcttggccccattaaat

SEQ ID NO: 65330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcagatcttggccccatta

SEQ ID NO: 65331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctactcagatcttggcccc

SEQ ID NO: 65332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggctactcagatcttggccc

SEQ ID NO: 65333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttggctactcagatcttggc

SEQ ID NO: 65334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtggcaaacactcttggcta

SEQ ID NO: 65335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtggcaaacactcttggct

SEQ ID NO: 65336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtggcaaacactcttggc

SEQ ID NO: 65337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttagtggcaaacactctt

SEQ ID NO: 65338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttactttagtggcaaacac

SEQ ID NO: 65339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttactttagtggcaaaca

SEQ ID NO: 65340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggttactttagtggcaaac

SEQ ID NO: 65341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttggttactttagtggcaa

SEQ ID NO: 65342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttggttactttagtggca

SEQ ID NO: 65343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggtttctttggttacttt

SEQ ID NO: 65344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataggtttctttggttactt

SEQ ID NO: 65345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataggtttctttggttact

SEQ ID NO: 65346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttataggtttctttggttac

SEQ ID NO: 65347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttataggtttctttggt

SEQ ID NO: 65348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaaaatgttatttttata

SEQ ID NO: 65349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acacaattaatgaaaatgtt

SEQ ID NO: 65350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgacacaattaatgaaaat

SEQ ID NO: 65351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgacacaattaatgaaaa

SEQ ID NO: 65352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgacacaattaatgaaa

SEQ ID NO: 65353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcattttattgacacaatt

SEQ ID NO: 65354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catcattttattgacacaat

SEQ ID NO: 65355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcttcatcattttattgac

SEQ ID NO: 65356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgcttcatcattttattga

SEQ ID NO: 65357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgcttcatcattttattg

SEQ ID NO: 65358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatgcttcatcattttatt

SEQ ID NO: 65359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttttatgcttcatcatttt

SEQ ID NO: 65360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttttatgcttcatcattt

SEQ ID NO: 65361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttttatgcttcatcatt

SEQ ID NO: 65362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccttttatgcttcatcat

SEQ ID NO: 65363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttccttttatgcttcatca

SEQ ID NO: 65364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttttccttttatgcttc

SEQ ID NO: 65365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaattgactttttcctttt

SEQ ID NO: 65366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaattgactttttccttt

SEQ ID NO: 65367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgagtttcagaattgactt

SEQ ID NO: 65368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgagtttcagaattgact

SEQ ID NO: 65369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgagtttcagaattgac

SEQ ID NO: 65370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagtgagtttcagaattga

SEQ ID NO: 65371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttagtgagtttcagaat

SEQ ID NO: 65372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttgcttttagtgagtttc

SEQ ID NO: 65373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgagttgcttttagtgagt

SEQ ID NO: 65374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgttgagttgcttttagtg

SEQ ID NO: 65375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcctgttgagttgctttta

SEQ ID NO: 65376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgttcctgttgagttgctt

SEQ ID NO: 65377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgttcctgttgagttgct

SEQ ID NO: 65378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgtatataccatcttattgt

SEQ ID NO: 65379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacaactccgtatataccat

SEQ ID NO: 65380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actacacaactccgtatata

SEQ ID NO: 65381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcattgactacacaactcc

SEQ ID NO: 65382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggcattgactacacaactc

SEQ ID NO: 65383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggcattgactacacaact

SEQ ID NO: 65384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaggcattgactacacaac

SEQ ID NO: 65385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttttaggcattgactacac

SEQ ID NO: 65386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctatttttaggcattgac

SEQ ID NO: 65387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accctatttttaggcattga

SEQ ID NO: 65388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagaaacatccatcttaccc

SEQ ID NO: 65389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acagaaacatccatcttacc

SEQ ID NO: 65390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttacagaaacatccatctt

SEQ ID NO: 65391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttacagaaacatccatct

SEQ ID NO: 65392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttccttacagaaacatcca

SEQ ID NO: 65393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatctatttccttacagaaa

SEQ ID NO: 65394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatctatttccttacagaa

SEQ ID NO: 65395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatctatttccttacaga

SEQ ID NO: 65396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaatctatttccttacag

SEQ ID NO: 65397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttaaatctatttccttac

SEQ ID NO: 65398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttaaatctatttcctta

SEQ ID NO: 65399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accttcttttaaatctattt

SEQ ID NO: 65400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttaaccttcttttaaatct

SEQ ID NO: 65401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttaaccttcttttaaatc

SEQ ID NO: 65402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggttaaccttcttttaaat

SEQ ID NO: 65403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttggttaaccttctttta

SEQ ID NO: 65404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttggttaaccttctttt

SEQ ID NO: 65405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattttggttaaccttctt

SEQ ID NO: 65406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttattttggttaaccttct

SEQ ID NO: 65407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttattttggttaacctt

SEQ ID NO: 65408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcttattttggttaacct

SEQ ID NO: 65409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcttcttattttggttaa

SEQ ID NO: 65410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattatttcttcttattttg

SEQ ID NO: 65411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acattatttcttcttatttt

SEQ ID NO: 65412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttacattatttcttcttat

SEQ ID NO: 65413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttacattatttcttctta

SEQ ID NO: 65414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcttacattatttcttctt

SEQ ID NO: 65415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttgcttacattatttctt

SEQ ID NO: 65416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actttgcttacattatttct

SEQ ID NO: 65417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatagaataaacaacttac

SEQ ID NO: 65418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcaaatagaataaacaact

SEQ ID NO: 65419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattcaaatagaataaacaa

SEQ ID NO: 65420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattcaaatagaataaaca

SEQ ID NO: 65421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaagtgtgaaaagcatat

SEQ ID NO: 65422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attacaaaagtgtgaaaagc

SEQ ID NO: 65423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaagcaattgattacaaaa

SEQ ID NO: 65424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaggaattacaaagcaat

SEQ ID NO: 65425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataaggaattacaaagcaa

SEQ ID NO: 65426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatttaataaggaattacaa

SEQ ID NO: 65427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatttaataaggaattaca

SEQ ID NO: 65428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagatttaataaggaattac

SEQ ID NO: 65429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagatttaataaggaatta

SEQ ID NO: 65430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttttagatttaataagg

SEQ ID NO: 65431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attaaatttttagatttaat

SEQ ID NO: 65432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taattaaatttttagattta

SEQ ID NO: 65433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctaattaaatttttagat

SEQ ID NO: 65434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accattgttctaattaaatt

SEQ ID NO: 65435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgttcaccattgttcta

SEQ ID NO: 65436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattaaaatgttcaccatt

SEQ ID NO: 65437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataattaaaatgttcaccat

SEQ ID NO: 65438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataattaaaatgttcacca

SEQ ID NO: 65439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttttataattaaaatgtt

SEQ ID NO: 65440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acctgagttttataattaaa

SEQ ID NO: 65441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacctgagttttataattaa

SEQ ID NO: 65442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacctgagttttataatta

SEQ ID NO: 65443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttgacctgagttttata

SEQ ID NO: 65444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattttgacctgagttttat

SEQ ID NO: 65445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaatcacacacttcatttt

SEQ ID NO: 65446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagaatcacacacttcattt

SEQ ID NO: 65447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcttcagaatcacacacttc

SEQ ID NO: 65448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcttcagaatcacacactt

SEQ ID NO: 65449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggcttagcttcagaatcac

SEQ ID NO: 65450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggcttagcttcagaatca

SEQ ID NO: 65451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagggcttagcttcagaatc

SEQ ID NO: 65452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagggcttagcttcagaat

SEQ ID NO: 65453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtgaataccacacttttag

SEQ ID NO: 65454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttgagtgaataccacactt

SEQ ID NO: 65455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttgagtgaataccacact

SEQ ID NO: 65456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agacatagatttagttgagt

SEQ ID NO: 65457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactaagacatagatttagt

SEQ ID NO: 65458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atactaagacatagatttag

SEQ ID NO: 65459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataagatttatactaagaca

SEQ ID NO: 65460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataagatttatactaagac

SEQ ID NO: 65461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taataagatttatactaaga

SEQ ID NO: 65462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaataagatttatactaag

SEQ ID NO: 65463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaataagatttatactaa

SEQ ID NO: 65464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatgttttttaataagat

SEQ ID NO: 65465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaaatgttttttaataaga

SEQ ID NO: 65466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaatcatgagtcttcaaaa

SEQ ID NO: 65467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccccaactcaaaatcatgag

SEQ ID NO: 65468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccccaactcaaaatcatga

SEQ ID NO: 65469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaatttgccccaactcaaa

SEQ ID NO: 65470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgagaatttgccccaactc

SEQ ID NO: 65471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttgagaatttgccccaact

SEQ ID NO: 65472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagggcagaagcaatcttgt

SEQ ID NO: 65473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaattgtagggcagaagca

SEQ ID NO: 65474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaattgtagggcagaagc

SEQ ID NO: 65475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagaaattgtagggcagaag

SEQ ID NO: 65476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atctttagaaattgtagggc

SEQ ID NO: 65477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgctaatctttagaaattg

SEQ ID NO: 65478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgctaatctttagaaatt

SEQ ID NO: 65479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtgctaatctttagaaat

SEQ ID NO: 65480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtagatctttggtgctaatc

SEQ ID NO: 65481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtagatctttggtgctaat

SEQ ID NO: 65482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttggtagatctttggtgct

SEQ ID NO: 65483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccatgaaaaactatttggta

SEQ ID NO: 65484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccatgaaaaactatttgg

SEQ ID NO: 65485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcccatgaaaaactatttg

SEQ ID NO: 65486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcccatgaaaaactattt

SEQ ID NO: 65487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcccatgaaaaactatt

SEQ ID NO: 65488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatttttctcccatgaaaa

SEQ ID NO: 65489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtacaattgtgatttttct

SEQ ID NO: 65490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtacaattgtgatttttc

SEQ ID NO: 65491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcagtacaattgtgatttt

SEQ ID NO: 65492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttcagtacaattgtgatt

SEQ ID NO: 65493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcttcagtacaattgtga

SEQ ID NO: 65494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attctctcttcagtacaatt

SEQ ID NO: 65495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcattctctcttcagtacaa

SEQ ID NO: 65496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctctcattctctcttcagta

SEQ ID NO: 65497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaagccaatgagatcagct

SEQ ID NO: 65498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attgtgaagccaatgagatc

SEQ ID NO: 65499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattgattgtgaagccaatg

SEQ ID NO: 65500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatctatattgattgtgaag

SEQ ID NO: 65501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatatctatattgattgtg

SEQ ID NO: 65502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attatatctatattgattgt

SEQ ID NO: 65503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttattatatctatattgatt

SEQ ID NO: 65504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acatgatgaagctcttatta

SEQ ID NO: 65505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctaacatgatgaagctctt

SEQ ID NO: 65506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atctatctaacatgatgaag

SEQ ID NO: 65507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggctgatctatctaacatg

SEQ ID NO: 65508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtaattgtggctgatcta

SEQ ID NO: 65509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttatggtaattgtggctga

SEQ ID NO: 65510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatactggttatggtaattg

SEQ ID NO: 65511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggatactggttatggtaatt

SEQ ID NO: 65512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggatactggttatggtaat

SEQ ID NO: 65513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggatactggttatggtaa

SEQ ID NO: 65514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttggatactggttatggt

SEQ ID NO: 65515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttggatactggttatgg

SEQ ID NO: 65516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatttcttttggatactgg

SEQ ID NO: 65517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgataagaactcaaatttct

SEQ ID NO: 65518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgataagaactcaaatttc

SEQ ID NO: 65519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agataatttacgataagaac

SEQ ID NO: 65520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagataatttacgataagaa

SEQ ID NO: 65521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaagataatttacgataag

SEQ ID NO: 65522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaagataatttacgataa

SEQ ID NO: 65523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttaagataatttacgata

SEQ ID NO: 65524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcttaagataatttacga

SEQ ID NO: 65525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgttctttcttaagataat

SEQ ID NO: 65526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcatgttctttcttaagat

SEQ ID NO: 65527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgttcatgttctttcttaa

SEQ ID NO: 65528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattgctgttcatgttcttt

SEQ ID NO: 65529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attgtattgctgttcatgtt

SEQ ID NO: 65530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatgtgtattgattgtatt

SEQ ID NO: 65531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taactaaaatgtgtattgat

SEQ ID NO: 65532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaactaaaatgtgtattga

SEQ ID NO: 65533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtaactaaaatgtgtattg

SEQ ID NO: 65534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttgtaactaaaatgtgta

SEQ ID NO: 65535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgctttgtaactaaaatg

SEQ ID NO: 65536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggtcatggaggagctcatt

SEQ ID NO: 65537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagatccagatctaaggtca

SEQ ID NO: 65538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagatccagatctaaggtc

SEQ ID NO: 65539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagagtaaacatatttata

SEQ ID NO: 65540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attcagagagtaaacatatt

SEQ ID NO: 65541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catggaactaattcagagag

SEQ ID NO: 65542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatggaactaattcagaga

SEQ ID NO: 65543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatggaactaattcagag

SEQ ID NO: 65544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacaggatgtgaggcaaatg

SEQ ID NO: 65545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctacacaggatgtgaggcaa

SEQ ID NO: 65546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgctacacaggatgtgagg

SEQ ID NO: 65547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacatcgtctcctgctacac

SEQ ID NO: 65548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agacatcgtctcctgctaca

SEQ ID NO: 65549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagacatcgtctcctgcta

SEQ ID NO: 65550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttagacatcgtctcctgct

SEQ ID NO: 65551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttagacatcgtctcctgc

SEQ ID NO: 65552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttagacatcgtctcctg

SEQ ID NO: 65553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagacatttttcttagacat

SEQ ID NO: 65554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattccagacatttttctta

SEQ ID NO: 65555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtaatgaagaactgcattcc

SEQ ID NO: 65556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcgtaatgaagaactgcat

SEQ ID NO: 65557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcgtaatgaagaactgca

SEQ ID NO: 65558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acttattcgtaatgaagaac

SEQ ID NO: 65559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtcactaacttattcgtaa

SEQ ID NO: 65560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcagtcactaacttattcgt

SEQ ID NO: 65561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatctctcagtcactaactt

SEQ ID NO: 65562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gaaaaattgaatctctcagt

SEQ ID NO: 65563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctcgaaaaattgaatctct

SEQ ID NO: 65564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctcgaaaaattgaatctc

SEQ ID NO: 65565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccctcgaaaaattgaatc

SEQ ID NO: 65566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcttccctcgaaaaattga

SEQ ID NO: 65567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattcttccctcgaaaaat

SEQ ID NO: 65568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcctattcttccctcgaaa

SEQ ID NO: 65569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctgttcctattcttccct

SEQ ID NO: 65570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatctgttcctattcttcc

SEQ ID NO: 65571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctctcatctgttcctattc

SEQ ID NO: 65572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatagataaatatataaag

SEQ ID NO: 65573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cgcctgaaatagataaatat

SEQ ID NO: 65574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacgcctgaaatagataaat

SEQ ID NO: 65575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacgcctgaaatagataaa

SEQ ID NO: 65576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctacgcctgaaatagataa

SEQ ID NO: 65577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctacgcctgaaatagata

SEQ ID NO: 65578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctacgcctgaaatagat

SEQ ID NO: 65579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaacaatgactttttctac

SEQ ID NO: 65580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgaacaatgactttttcta

SEQ ID NO: 65581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgaacaatgactttttct

SEQ ID NO: 65582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgaacaatgactttttc

SEQ ID NO: 65583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgtgaacaatgacttttt

SEQ ID NO: 65584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggtaacagcaatgaactt

SEQ ID NO: 65585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatggtaacagcaatgaac

SEQ ID NO: 65586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctctgatggtaacagcaat

SEQ ID NO: 65587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgtctctgatggtaacag

SEQ ID NO: 65588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctgtctctgatggtaaca

SEQ ID NO: 65589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcagtcagtttacctgtct

SEQ ID NO: 65590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catcagtcagtttacctgtc

SEQ ID NO: 65591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccgcttcatcagtcagttta

SEQ ID NO: 65592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccgcttcatcagtcagttt

SEQ ID NO: 65593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacacttcccgcttcatca

SEQ ID NO: 65594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacacttcccgcttcatc

SEQ ID NO: 65595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaacacttcccgcttcat

SEQ ID NO: 65596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgaggatgagcactttaa

SEQ ID NO: 65597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaatactacatgaggatga

SEQ ID NO: 65598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgagacatctggaaatact

SEQ ID NO: 65599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgagacatctggaaatac

SEQ ID NO: 65600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttagtgagacatctgga

SEQ ID NO: 65601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaaaaagccatgttaca

SEQ ID NO: 65602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaaaaaagccatgttac

SEQ ID NO: 65603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaatttaaaaaaaaaagcc

SEQ ID NO: 65604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggaatttaaaaaaaaaagc

SEQ ID NO: 65605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taggaatttaaaaaaaaaag

SEQ ID NO: 65606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatacgtagctttaggaatt

SEQ ID NO: 65607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctaaatacgtagctttagga

SEQ ID NO: 65608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgctaaatacgtagctttag

SEQ ID NO: 65609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctgctaaatacgtagctt

SEQ ID NO: 65610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctgctaaatacgtagct

SEQ ID NO: 65611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagtggcatgaggagtaat

SEQ ID NO: 65612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagagtggcatgaggagtaa

SEQ ID NO: 65613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcaaatttaagagtggcat

SEQ ID NO: 65614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtggaaaataatggatgtg

SEQ ID NO: 65615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagtggaaaataatggatgt

SEQ ID NO: 65616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaagtggaaaataatggat

SEQ ID NO: 65617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtgttcttaagtggaaaa

SEQ ID NO: 65618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagtgttcttaagtggaaa

SEQ ID NO: 65619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaagtgttcttaagtggaa

SEQ ID NO: 65620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagagggagcatacatattt

SEQ ID NO: 65621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attaaagagggagcatacat

SEQ ID NO: 65622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgattaaagagggagcatac

SEQ ID NO: 65623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgattaaagagggagcata

SEQ ID NO: 65624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgattaaagagggagcat

SEQ ID NO: 65625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaaaaattttctgatta

SEQ ID NO: 65626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaccacagcaaaacattaa

SEQ ID NO: 65627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaagggacaaacattcaaa

SEQ ID NO: 65628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaagggacaaacattcaa

SEQ ID NO: 65629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caacatgagtttcaaaaggg

SEQ ID NO: 65630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttccaacatgagtttcaa

SEQ ID NO: 65631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaattaagttccaacatga

SEQ ID NO: 65632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattgggaattaagttccaa

SEQ ID NO: 65633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttacattgggaattaagttc

SEQ ID NO: 65634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atactgttacattgggaatt

SEQ ID NO: 65635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatactgttacattgggaat

SEQ ID NO: 65636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaatactgttacattggga

SEQ ID NO: 65637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcttaatactgttacatt

SEQ ID NO: 65638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcctcttaatactgttaca

SEQ ID NO: 65639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggctctgcctcttaatac

SEQ ID NO: 65640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaggctctgcctcttaata

SEQ ID NO: 65641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaggctctgcctcttaat

SEQ ID NO: 65642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaggctctgcctcttaa

SEQ ID NO: 65643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcaccttttaaaggctctg

SEQ ID NO: 65644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgacctcatcaccttttaa

SEQ ID NO: 65645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgacctcatcacctttta

SEQ ID NO: 65646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaaggcagaaccttcatg

SEQ ID NO: 65647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattcatgaaggcagaacct

SEQ ID NO: 65648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattccattcatgaaggcag

SEQ ID NO: 65649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatattccattcatgaaggc

SEQ ID NO: 65650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctatattccattcatgaa

SEQ ID NO: 65651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actctatattccattcatga

SEQ ID NO: 65652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcccttactctatattcca

SEQ ID NO: 65653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccatgataacccattaagcc

SEQ ID NO: 65654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actcccatgataacccatta

SEQ ID NO: 65655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actcactcccatgataaccc

SEQ ID NO: 65656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatatctaactcactccca

SEQ ID NO: 65657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgatatctaactcactccc

SEQ ID NO: 65658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtgatatctaactcactc

SEQ ID NO: 65659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taataaacccactcttgtga

SEQ ID NO: 65660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataataaacccactcttgtg

SEQ ID NO: 65661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataataaacccactcttgt

SEQ ID NO: 65662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggttttataataaacccact

SEQ ID NO: 65663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agagccaaactgggttttat

SEQ ID NO: 65664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgagagccaaactgggtt

SEQ ID NO: 65665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atggcatcacatggcgaggg

SEQ ID NO: 65666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgggcacaccagagagtcc

SEQ ID NO: 65667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctggtgggcacaccagagag

SEQ ID NO: 65668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctggtgggcacaccagaga

SEQ ID NO: 65669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgctggtgggcacaccaga

SEQ ID NO: 65670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgctggtgggcacaccag

SEQ ID NO: 65671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttgctggtgggcacacca

SEQ ID NO: 65672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgggaactttcttgctggt

SEQ ID NO: 65673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggtgaagggtccacatctg

SEQ ID NO: 65674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaagtctaaggtgaagggt

SEQ ID NO: 65675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagctgggaagtctaaggt

SEQ ID NO: 65676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaagctgggaagtctaag

SEQ ID NO: 65677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagttctggaagctgggaag

SEQ ID NO: 65678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagttctggaagctgggaa

SEQ ID NO: 65679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaagttctggaagctggg

SEQ ID NO: 65680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaaagttctggaagctgg

SEQ ID NO: 65681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcttaaagttctggaagc

SEQ ID NO: 65682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcttaaagttctggaag

SEQ ID NO: 65683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aataaagaaatttatttctt

SEQ ID NO: 65684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtattcaataaagaaatt

SEQ ID NO: 65685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttaaagtattcaataaaga

SEQ ID NO: 65686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agactggttaaagtattcaa

SEQ ID NO: 65687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatacctgagactggttaaa

SEQ ID NO: 65688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taactgaatacctgagactg

SEQ ID NO: 65689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtaactgaatacctgaga

SEQ ID NO: 65690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgctgtaactgaatacctg

SEQ ID NO: 65691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgctgtaactgaatacct

SEQ ID NO: 65692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgctgtaactgaatacc

SEQ ID NO: 65693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattgctgtaactgaatac

SEQ ID NO: 65694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccttttattgctgtaactga

SEQ ID NO: 65695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtctaccttttattgctgta

SEQ ID NO: 65696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtctaccttttattgctgt

SEQ ID NO: 65697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taacagacatgtcttagtct

SEQ ID NO: 65698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatcaattataacagacatg

SEQ ID NO: 65699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggggctgtatcaattataac

SEQ ID NO: 65700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggggctgtatcaattataa

SEQ ID NO: 65701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggggctgtatcaattata

SEQ ID NO: 65702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtattttaggggctgtatca

SEQ ID NO: 65703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttagtattttaggggctgta

SEQ ID NO: 65704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagaacagacctattagtat

SEQ ID NO: 65705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggagaacagacctattagta

SEQ ID NO: 65706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagtggcttggagaacaga

SEQ ID NO: 65707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacagtggcttggagaacag

SEQ ID NO: 65708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acttaacagtggcttggaga

SEQ ID NO: 65709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgtgtcataaaactcactta

SEQ ID NO: 65710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatatgcatatattccgt

SEQ ID NO: 65711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aataatatgcatatattccg

SEQ ID NO: 65712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taccatagtcttaataatat

SEQ ID NO: 65713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaactataccatagtctta

SEQ ID NO: 65714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agttacaaactataccatag

SEQ ID NO: 65715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagttacaaactataccat

SEQ ID NO: 65716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagaaagatgtgaatatata

SEQ ID NO: 65717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagaaagatgtgaatatat

SEQ ID NO: 65718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatatatacgtgtgtgttta

SEQ ID NO: 65719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatatatacgtgtgtgttt

SEQ ID NO: 65720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtacaggcgtatatttgta

SEQ ID NO: 65721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtacaggcgtatatttgt

SEQ ID NO: 65722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcagtacaggcgtatattt

SEQ ID NO: 65723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacagtgttcttcagtacag

SEQ ID NO: 65724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attaaacagtgttcttcagt

SEQ ID NO: 65725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gattaaacagtgttcttcag

SEQ ID NO: 65726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgattaaacagtgttctt

SEQ ID NO: 65727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acttgattaaacagtgttct

SEQ ID NO: 65728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaacttacttgattaaacag

SEQ ID NO: 65729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaacttacttgattaaaca

SEQ ID NO: 65730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgaaacttacttgattaa

SEQ ID NO: 65731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggttatttgaaacttacttg

SEQ ID NO: 65732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggttatttgaaacttact

SEQ ID NO: 65733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgggttatttgaaacttac

SEQ ID NO: 65734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caggcttctgggttatttga

SEQ ID NO: 65735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcaggcttctgggttattt

SEQ ID NO: 65736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcaggcttctgggttatt

SEQ ID NO: 65737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttctgcaggcttctgggt

SEQ ID NO: 65738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgatttctgcaggcttct

SEQ ID NO: 65739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtctgatttctgcaggcttc

SEQ ID NO: 65740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagaatggacttgtctgat

SEQ ID NO: 65741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcagagaatggacttgtct

SEQ ID NO: 65742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctactcagagaatggacttg

SEQ ID NO: 65743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctactcagagaatggactt

SEQ ID NO: 65744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgctactcagagaatgga

SEQ ID NO: 65745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattatttgctactcagaga

SEQ ID NO: 65746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atattatttgctactcagag

SEQ ID NO: 65747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttatattatttgctactca

SEQ ID NO: 65748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaactacttatattatttg

SEQ ID NO: 65749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaactacttatattattt

SEQ ID NO: 65750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatttcagaactacttata

SEQ ID NO: 65751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatattcagatttcagaact

SEQ ID NO: 65752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgtatattcagatttcaga

SEQ ID NO: 65753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttgtatattcagatttca

SEQ ID NO: 65754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagatgattctgttgtatat

SEQ ID NO: 65755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taacaagccctacagatgat

SEQ ID NO: 65756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgtggcaaatcattgtaa

SEQ ID NO: 65757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggttggatgtggcaaatca

SEQ ID NO: 65758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggggttggatgtggcaaat

SEQ ID NO: 65759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatcagaaactctggggttg

SEQ ID NO: 65760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccccaaccccaagacatac

SEQ ID NO: 65761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcccccaaccccaagacat

SEQ ID NO: 65762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataagagatgcaaattctgc

SEQ ID NO: 65763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcacatgtaggtgagaactc

SEQ ID NO: 65764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaacgttggcacatgtagg

SEQ ID NO: 65765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaactgaaaacgttggcac

SEQ ID NO: 65766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggatggtctcaaaactga

SEQ ID NO: 65767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaggatggtctcaaaactg

SEQ ID NO: 65768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaaggatggtctcaaaac

SEQ ID NO: 65769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcttgaaggatggtctcaa

SEQ ID NO: 65770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagcagttgttcttgaagga

SEQ ID NO: 65771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctacagcagttgttcttga

SEQ ID NO: 65772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctacagcagttgttcttg

SEQ ID NO: 65773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaagtatagaaacttatct

SEQ ID NO: 65774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaaagtatagaaacttat

SEQ ID NO: 65775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgaaaagtatagaaactta

SEQ ID NO: 65776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgaaaagtatagaaactt

SEQ ID NO: 65777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgaaaagtatagaaact

SEQ ID NO: 65778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctgaaaagtatagaaac

SEQ ID NO: 65779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctgaaaagtatagaaa

SEQ ID NO: 65780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttctgaaaagtatagaa

SEQ ID NO: 65781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttctgaaaagtataga

SEQ ID NO: 65782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttctgaaaagtatag

SEQ ID NO: 65783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttctgaaaagtata

SEQ ID NO: 65784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttctgaaaagtat

SEQ ID NO: 65785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attttttttttttctgaaaa

SEQ ID NO: 65786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggggagtggctgattttttt

SEQ ID NO: 65787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggggagtggctgatttttt

SEQ ID NO: 65788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggacacagatttgggggagt

SEQ ID NO: 65789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggacacagatttgggggag

SEQ ID NO: 65790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggacacagatttggggga

SEQ ID NO: 65791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acagagatgcaaattttggg

SEQ ID NO: 65792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgacagagatgcaaatttt

SEQ ID NO: 65793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgacagagatgcaaattt

SEQ ID NO: 65794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgctgacagagatgcaaat

SEQ ID NO: 65795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacacaatattcttgctgac

SEQ ID NO: 65796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaacgaacaaatataatgc

SEQ ID NO: 65797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaacgaacaaatataatg

SEQ ID NO: 65798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaaacgaacaaatataat

SEQ ID NO: 65799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atattttggaaacgaacaaa

SEQ ID NO: 65800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatattttggaaacgaacaa

SEQ ID NO: 65801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaatattttggaaacgaa

SEQ ID NO: 65802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatattatttaatattttg

SEQ ID NO: 65803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaatattatttaatatttt

SEQ ID NO: 65804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caatttgaaatattatttaa

SEQ ID NO: 65805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggggtatgtaatgtgcaga

SEQ ID NO: 65806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcaggggtatgtaatgtgc

SEQ ID NO: 65807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgttcaggggtatgtaatg

SEQ ID NO: 65808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtgagtataacctcctgtt

SEQ ID NO: 65809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagtgagtataacctcctg

SEQ ID NO: 65810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtgatgattctcagtgag

SEQ ID NO: 65811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtgatgattctcagtga

SEQ ID NO: 65812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaatttaaagtgatgattc

SEQ ID NO: 65813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaatttaaagtgatgatt

SEQ ID NO: 65814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgaaaatttaaagtgatg

SEQ ID NO: 65815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgaaaatttaaagtgat

SEQ ID NO: 65816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttgaaaatttaaagtga

SEQ ID NO: 65817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttatttgaaaatttaaag

SEQ ID NO: 65818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatggaaattgttttatt

SEQ ID NO: 65819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataatggaaattgttttat

SEQ ID NO: 65820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttaataatggaaattgttt

SEQ ID NO: 65821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagatatggctgtttaata

SEQ ID NO: 65822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaagagatatggctgtt

SEQ ID NO: 65823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattaagagatatggctgt

SEQ ID NO: 65824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaattaagagatatggctg

SEQ ID NO: 65825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaaattaagagatatgg

SEQ ID NO: 65826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttaaattaagagatatg

SEQ ID NO: 65827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacttattttaaattaagag

SEQ ID NO: 65828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagtaaaattgaacttatt

SEQ ID NO: 65829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaagtaaaattgaacttat

SEQ ID NO: 65830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgtaagaaatgaaggttt

SEQ ID NO: 65831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcattcagtgtaagaaatg

SEQ ID NO: 65832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcattcagtgtaagaaat

SEQ ID NO: 65833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatcattcagtgtaagaaa

SEQ ID NO: 65834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attttcatcattcagtgtaa

SEQ ID NO: 65835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcacaaatacactcattttc

SEQ ID NO: 65836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatattatcacaaatacac

SEQ ID NO: 65837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatattatcacaaataca

SEQ ID NO: 65838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaatattatcacaaatac

SEQ ID NO: 65839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatctttaaaatattatca

SEQ ID NO: 65840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatctttaaaatattatc

SEQ ID NO: 65841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatctttaaaatattat

SEQ ID NO: 65842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatattttaaaatctttaaa

SEQ ID NO: 65843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatattttaaaatctttaa

SEQ ID NO: 65844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagatattttaaaatcttta

SEQ ID NO: 65845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacaatattttagatatttt

SEQ ID NO: 65846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaattatacaatatttta

SEQ ID NO: 65847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaaaattatacaatatttt

SEQ ID NO: 65848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaaaaaattatacaatatt

SEQ ID NO: 65849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttaaaaaattatacaata

SEQ ID NO: 65850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctcttaaaaaattatacaa

SEQ ID NO: 65851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaatatgacggggtctctc

SEQ ID NO: 65852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactgtaaatatgacggggt

SEQ ID NO: 65853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaactgtaaatatgacgggg

SEQ ID NO: 65854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaaactgtaaatatgacgg

SEQ ID NO: 65855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttaaactgtaaatatgac

SEQ ID NO: 65856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttaaactgtaaatatga

SEQ ID NO: 65857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcttaaactgtaaatatg

SEQ ID NO: 65858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctcttaaactgtaaatat

SEQ ID NO: 65859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttctcttaaactgtaaat

SEQ ID NO: 65860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttctcttaaactgtaaa

SEQ ID NO: 65861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttctcttaaactgtaa

SEQ ID NO: 65862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagaaggaatgtagattttc

SEQ ID NO: 65863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccccaaataagaagaaatta

SEQ ID NO: 65864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaaaggctgccccaaata

SEQ ID NO: 65865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagaaaggctgccccaaat

SEQ ID NO: 65866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagaaaggctgccccaaa

SEQ ID NO: 65867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatatagtagttttgaaga

SEQ ID NO: 65868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaatatagtagttttgaag

SEQ ID NO: 65869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaatatagtagttttgaa

SEQ ID NO: 65870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtaatatagtagttttga

SEQ ID NO: 65871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaaatgaaaaatgataaaa

SEQ ID NO: 65872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctaaaaaatgaaaaatgat

SEQ ID NO: 65873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgcctaaaaaatgaaaaat

SEQ ID NO: 65874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttactgcctaaaaaatgaa

SEQ ID NO: 65875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctagttactgcctaaaaaa

SEQ ID NO: 65876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatatcaagttatctagtt

SEQ ID NO: 65877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcattcatatatcaagtta

SEQ ID NO: 65878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattaatcattcatatatca

SEQ ID NO: 65879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattaatcattcatatatc

SEQ ID NO: 65880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaattaatcattcatatat

SEQ ID NO: 65881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaattaatcattcatata

SEQ ID NO: 65882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttttcaattaatcattcat

SEQ ID NO: 65883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctatttttcaattaatcatt

SEQ ID NO: 65884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctatttttcaattaatcat

SEQ ID NO: 65885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgctatttttcaattaatc

SEQ ID NO: 65886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgctatttttcaattaat

SEQ ID NO: 65887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggatatagtaatgatttctt

SEQ ID NO: 65888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cggatatagtaatgatttct

SEQ ID NO: 65889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acttcggatatagtaatgat

SEQ ID NO: 65890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taacttcggatatagtaatg

SEQ ID NO: 65891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgagaattctaacttcggat

SEQ ID NO: 65892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatgagaattctaacttcgg

SEQ ID NO: 65893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctatgagaattctaactt

SEQ ID NO: 65894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctctatgagaattctaact

SEQ ID NO: 65895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtttcctctatgagaattc

SEQ ID NO: 65896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggtttcctctatgagaatt

SEQ ID NO: 65897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttaggtttcctctatgag

SEQ ID NO: 65898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgtgttatcttaggtttc

SEQ ID NO: 65899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatgtgttatcttaggttt

SEQ ID NO: 65900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caccttatatgtgttatctt

SEQ ID NO: 65901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatattacaccttatatgtg

SEQ ID NO: 65902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatagctatatattacacc

SEQ ID NO: 65903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacatagctatatattacac

SEQ ID NO: 65904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacatagctatatattaca

SEQ ID NO: 65905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaacatagctatatattac

SEQ ID NO: 65906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taatatgtaatgtgaaaaaa

SEQ ID NO: 65907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataatatgtaatgtgaaaa

SEQ ID NO: 65908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctataatatgtaatgtgaaa

SEQ ID NO: 65909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctataatatgtaatgtgaa

SEQ ID NO: 65910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctataatatgtaatgtga

SEQ ID NO: 65911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctataatatgtaatgtg

SEQ ID NO: 65912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttctataatatgtaatgt

SEQ ID NO: 65913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaacaataacttttttcta

SEQ ID NO: 65914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgttaaaaacaataactt

SEQ ID NO: 65915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcacacaacatattaaatg

SEQ ID NO: 65916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatcacacaacatattaaat

SEQ ID NO: 65917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaatcacacaacatattaa

SEQ ID NO: 65918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaatcacacaacatatta

SEQ ID NO: 65919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttaatcacacaacatatt

SEQ ID NO: 65920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gttttcttaatcacacaaca

SEQ ID NO: 65921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgttttcttaatcacacaac

SEQ ID NO: 65922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgttttcttaatcacacaa

SEQ ID NO: 65923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaaaaataataataattt

SEQ ID NO: 65924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catctcaaaaaaaataataa

SEQ ID NO: 65925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggcgacagggtgagactcca

SEQ ID NO: 65926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggcgacagggtgagactcc

SEQ ID NO: 65927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcttgggcgacagggtga

SEQ ID NO: 65928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactccagcttgggcgacag

SEQ ID NO: 65929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgagtcgagatcgtgcca

SEQ ID NO: 65930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtgagtcgagatcgtgcc

SEQ ID NO: 65931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacccggtaggcagaggttt

SEQ ID NO: 65932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaacccggtaggcagaggtt

SEQ ID NO: 65933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcagaagaatcgcttgaa

SEQ ID NO: 65934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggaggctgaggcagaagaa

SEQ ID NO: 65935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcaggaggctgaggcagaa

SEQ ID NO: 65936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatcccagctactcaggag

SEQ ID NO: 65937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccagacatggtggcaggtg

SEQ ID NO: 65938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaaatacaaaaaattagcc

SEQ ID NO: 65939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaaaaatacaaaaaatta

SEQ ID NO: 65940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactaaaaaatacaaaaaat

SEQ ID NO: 65941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccaacatggtgaaaccccg

SEQ ID NO: 65942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaccagcctggccaacatg

SEQ ID NO: 65943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaccagcctggccaacat

SEQ ID NO: 65944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtcaggagtttgagacca

SEQ ID NO: 65945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagtccgaggcaggtggat

SEQ ID NO: 65946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagagtccgaggcaggtgga

SEQ ID NO: 65947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagagtccgaggcaggtgg

SEQ ID NO: 65948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatcccagcactttgagag

SEQ ID NO: 65949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acgcctgtaatcccagcact

SEQ ID NO: 65950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccaggcgcggtagctcacg

SEQ ID NO: 65951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggccaggcgcggtagctca

SEQ ID NO: 65952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggccaggcgcggtagctc

SEQ ID NO: 65953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcttctggccaggcgcggta

SEQ ID NO: 65954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcttctggccaggcgcggt

SEQ ID NO: 65955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggcttctggccaggcgcgg

SEQ ID NO: 65956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggcttctggccaggcgcg

SEQ ID NO: 65957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaacttttggcttctggc

SEQ ID NO: 65958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cataaacttttggcttctgg

SEQ ID NO: 65959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagcttcataaacttttgg

SEQ ID NO: 65960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaaagcttcataaacttt

SEQ ID NO: 65961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttattcaaagcttcataaac

SEQ ID NO: 65962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aactgttattcaaagcttca

SEQ ID NO: 65963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaactgttattcaaagctt

SEQ ID NO: 65964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaactgttattcaaagct

SEQ ID NO: 65965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatttctcaactgttattca

SEQ ID NO: 65966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaagttcaatttctcaact

SEQ ID NO: 65967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcaaaagttcaatttctca

SEQ ID NO: 65968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcaaaagttcaatttctc

SEQ ID NO: 65969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcatatttactcaaaagtt

SEQ ID NO: 65970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaaattagtcatatttact

SEQ ID NO: 65971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaaatgttaccaaattagt

SEQ ID NO: 65972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actgcaaaatgttaccaaat

SEQ ID NO: 65973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaatcacaagtaagcatg

SEQ ID NO: 65974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atacagcatcatatgtggat

SEQ ID NO: 65975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattcatacagcatcatatg

SEQ ID NO: 65976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaaagttgaattcataca

SEQ ID NO: 65977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaaaagttgaattcatac

SEQ ID NO: 65978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagaaaagttgaattcata

SEQ ID NO: 65979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaagaaaagttgaattcat

SEQ ID NO: 65980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcgagcttttaagaaaagtt

SEQ ID NO: 65981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattatcgagcttttaagaa

SEQ ID NO: 65982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcattatcgagcttttaaga

SEQ ID NO: 65983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accaagggtttgcattatcg

SEQ ID NO: 65984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaccaagggtttgcattatc

SEQ ID NO: 65985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatttaaccaagggtttgc

SEQ ID NO: 65986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatttaaccaagggtttg

SEQ ID NO: 65987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaatttaaccaagggttt

SEQ ID NO: 65988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatatgccaataagtgcttt

SEQ ID NO: 65989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatatgccaataagtgctt

SEQ ID NO: 65990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaggtcaacacgcaaatttg

SEQ ID NO: 65991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acataattagaggtcaacac

SEQ ID NO: 65992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catatgatgcctgacataat

SEQ ID NO: 65993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatatgatgcctgacataa

SEQ ID NO: 65994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatatgatgcctgacata

SEQ ID NO: 65995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttccatatgatgcctgac

SEQ ID NO: 65996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttccatatgatgcctga

SEQ ID NO: 65997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagatttgttttccatatga

SEQ ID NO: 65998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagatttgttttccatatg

SEQ ID NO: 65999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagagatttgttttccatat

SEQ ID NO: 66000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagagatttgttttccata

SEQ ID NO: 66001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taatcagtcatagtttttag

SEQ ID NO: 66002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggaagaaacatcctataat

SEQ ID NO: 66003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggaagaaacatcctataa

SEQ ID NO: 66004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttagggaagaaacatcc

SEQ ID NO: 66005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtttagggaagaaacatc

SEQ ID NO: 66006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgtttagggaagaaacat

SEQ ID NO: 66007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acctttgtgtttagggaaga

SEQ ID NO: 66008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaacctaacctttgtgtt

SEQ ID NO: 66009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaaacctaacctttgtgt

SEQ ID NO: 66010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagaaacctaacctttgtg

SEQ ID NO: 66011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gattttcagaaacctaacct

SEQ ID NO: 66012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagattttcagaaacctaac

SEQ ID NO: 66013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctagattttcagaaacctaa

SEQ ID NO: 66014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctagattttcagaaacct

SEQ ID NO: 66015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attcttctagattttcagaa

SEQ ID NO: 66016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaattcttctagattttca

SEQ ID NO: 66017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actaattcttctagattttc

SEQ ID NO: 66018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactaattcttctagatttt

SEQ ID NO: 66019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttactaattcttctagattt

SEQ ID NO: 66020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttttactaattcttctag

SEQ ID NO: 66021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcttttactaattcttcta

SEQ ID NO: 66022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatcttttactaattcttct

SEQ ID NO: 66023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttatcttttactaattctt

SEQ ID NO: 66024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaatgatatgttctttatc

SEQ ID NO: 66025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagaatgatatgttcttta

SEQ ID NO: 66026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcagaatgatatgttcttt

SEQ ID NO: 66027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcagaatgatatgttctt

SEQ ID NO: 66028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcagaatgatatgttct

SEQ ID NO: 66029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttctcagaatgatatgt

SEQ ID NO: 66030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttttctcagaatgatatg

SEQ ID NO: 66031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccagtcttatttttctcaga

SEQ ID NO: 66032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatctcccagtcttattttt

SEQ ID NO: 66033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taacctcaatctcccagtct

SEQ ID NO: 66034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataacctcaatctcccagtc

SEQ ID NO: 66035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataacctcaatctcccagt

SEQ ID NO: 66036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttataacctcaatctccc

SEQ ID NO: 66037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattattttataacctcaat

SEQ ID NO: 66038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acattattttataacctcaa

SEQ ID NO: 66039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacattattttataacctc

SEQ ID NO: 66040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttacattattttataacct

SEQ ID NO: 66041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttacattattttataacc

SEQ ID NO: 66042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatggctttcttacattat

SEQ ID NO: 66043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaaaatggctttcttaca

SEQ ID NO: 66044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattaattaaaatggctttc

SEQ ID NO: 66045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattaattaaaatggcttt

SEQ ID NO: 66046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtattaattaaaatggctt

SEQ ID NO: 66047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatatatatgacatattt

SEQ ID NO: 66048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aataatatatatgacatatt

SEQ ID NO: 66049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatataacttaataatat

SEQ ID NO: 66050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataatataacttaataata

SEQ ID NO: 66051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taataatataacttaataat

SEQ ID NO: 66052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattttaataatataactta

SEQ ID NO: 66053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattttaataatataactt

SEQ ID NO: 66054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatattttaataatataact

SEQ ID NO: 66055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttatattttaataatata

SEQ ID NO: 66056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attattttatattttaataa

SEQ ID NO: 66057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taattattttatattttaat

SEQ ID NO: 66058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgtactctaattatttta

SEQ ID NO: 66059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgaatgtactctaattat

SEQ ID NO: 66060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgaatgtactctaatta

SEQ ID NO: 66061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatttcattgaatgtactc

SEQ ID NO: 66062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatcatttcattgaatgta

SEQ ID NO: 66063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acggtacaatacccattatt

SEQ ID NO: 66064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatagaaactaacggtaca

SEQ ID NO: 66065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaaatagaaactaacggta

SEQ ID NO: 66066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatagtcggtgagatcaag

SEQ ID NO: 66067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaatagtcggtgagatcaa

SEQ ID NO: 66068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatagagaagaaatcttaa

SEQ ID NO: 66069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attgagatagagaagaaatc

SEQ ID NO: 66070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgattgagatagagaagaaa

SEQ ID NO: 66071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgattgagatagagaagaa

SEQ ID NO: 66072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggcttctgattgagatag

SEQ ID NO: 66073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaggcttctgattgagata

SEQ ID NO: 66074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaggcttctgattgagat

SEQ ID NO: 66075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacaggcttctgattgaga

SEQ ID NO: 66076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acgaagtagaaatattttta

SEQ ID NO: 66077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacgaagtagaaatattttt

SEQ ID NO: 66078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacgaagtagaaatatttt

SEQ ID NO: 66079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaacgaagtagaaatat

SEQ ID NO: 66080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catattattttaacgaagta

SEQ ID NO: 66081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatattattttaacgaagt

SEQ ID NO: 66082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttacatattattttaacg

SEQ ID NO: 66083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttacatattattttaac

SEQ ID NO: 66084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtttacatattattttaa

SEQ ID NO: 66085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttagtttacatattatttt

SEQ ID NO: 66086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgatggaaaatacataat

SEQ ID NO: 66087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggatgatggaaaatacataa

SEQ ID NO: 66088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatacttggatgatggaaaa

SEQ ID NO: 66089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgaatacttggatgatgga

SEQ ID NO: 66090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagaactgttgaatacttg

SEQ ID NO: 66091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataataaattcaaagaact

SEQ ID NO: 66092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agataataaattcaaagaac

SEQ ID NO: 66093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagataataaattcaaagaa

SEQ ID NO: 66094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtaataattttagataat

SEQ ID NO: 66095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaatgtaataattttagat

SEQ ID NO: 66096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattaatgtaataatttta

SEQ ID NO: 66097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagaatggcagtggggcaga

SEQ ID NO: 66098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctccagaatggcagtggg

SEQ ID NO: 66099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catctccagaatggcagtgg

SEQ ID NO: 66100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccttcatctccagaatggc

SEQ ID NO: 66101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcccttcatctccagaatgg

SEQ ID NO: 66102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatatgcgacttgcccttc

SEQ ID NO: 66103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctcaaatatgcgacttgcc

SEQ ID NO: 66104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatctcaaatatgcgacttg

SEQ ID NO: 66105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctctatctcaaatatgcga

SEQ ID NO: 66106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggaaaaaccaaaatgaga

SEQ ID NO: 66107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agacccaattataggaaaaa

SEQ ID NO: 66108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctcagacccaattatagga

SEQ ID NO: 66109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatatctatctcagaccca

SEQ ID NO: 66110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatatctatctcagaccc

SEQ ID NO: 66111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatatctatctcagacc

SEQ ID NO: 66112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggagagagaagtcatgaaa

SEQ ID NO: 66113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggggagagagaagtcatgaa

SEQ ID NO: 66114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttggggagagagaagtc

SEQ ID NO: 66115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttggggagagagaagt

SEQ ID NO: 66116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtatttggggagagagaag

SEQ ID NO: 66117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actttgtatttggggagaga

SEQ ID NO: 66118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacaaatacaaagttaactt

SEQ ID NO: 66119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatcattatacaaataca

SEQ ID NO: 66120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaaatcattatacaaata

SEQ ID NO: 66121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaaaatcattatacaaat

SEQ ID NO: 66122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaaaaatcattatacaaa

SEQ ID NO: 66123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctaaaaatcattatacaa

SEQ ID NO: 66124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatttttctaaaaatcatt

SEQ ID NO: 66125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatgtgagctaaaattttt

SEQ ID NO: 66126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctgatatgtgagctaaaat

SEQ ID NO: 66127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagataagagaggatgagg

SEQ ID NO: 66128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataatgtaaaattggaagat

SEQ ID NO: 66129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcataatgtaaaattggaa

SEQ ID NO: 66130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagagaggaaatgatgatta

SEQ ID NO: 66131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagtaggagatgataaaag

SEQ ID NO: 66132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaagtaggagatgataaaa

SEQ ID NO: 66133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaataaaacaaaatttaga

SEQ ID NO: 66134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaagaataaaacaaaattt

SEQ ID NO: 66135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttaagaataaaacaaaatt

SEQ ID NO: 66136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgttaagaataaaacaaaa

SEQ ID NO: 66137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgtcattcttgttaagaa

SEQ ID NO: 66138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatgtcattcttgttaaga

SEQ ID NO: 66139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaatatgatttgaatgtc

SEQ ID NO: 66140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaatatgatttgaatgt

SEQ ID NO: 66141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaatatgatttgaatg

SEQ ID NO: 66142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaaatatgatttgaat

SEQ ID NO: 66143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaaaatatgatttgaa

SEQ ID NO: 66144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaaggagatgtgatttttt

SEQ ID NO: 66145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcaaaggagatgtgatttt

SEQ ID NO: 66146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcaaaggagatgtgattt

SEQ ID NO: 66147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgcaaaggagatgtgatt

SEQ ID NO: 66148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttttctgcaaaggagatg

SEQ ID NO: 66149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgttttctgcaaaggagat

SEQ ID NO: 66150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgttttctgcaaaggaga

SEQ ID NO: 66151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatgttttctgcaaaggag

SEQ ID NO: 66152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatgttttctgcaaagga

SEQ ID NO: 66153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttttttatgttttctgca

SEQ ID NO: 66154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattgagttttttatgttt

SEQ ID NO: 66155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataattgagttttttatgtt

SEQ ID NO: 66156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taacatttataattgagttt

SEQ ID NO: 66157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgacattgtaacatttataa

SEQ ID NO: 66158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgacattgtaacatttat

SEQ ID NO: 66159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtgacattgtaacattta

SEQ ID NO: 66160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctgtgacattgtaacat

SEQ ID NO: 66161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacaaatgtaaattatttct

SEQ ID NO: 66162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaacagaaatcgttcaacaa

SEQ ID NO: 66163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaggaatattagaacagaa

SEQ ID NO: 66164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acacagccagtggaaatata

SEQ ID NO: 66165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaatattaacacagccagt

SEQ ID NO: 66166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaatattaacacagccag

SEQ ID NO: 66167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaaatattaacacagcca

SEQ ID NO: 66168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagaaatattaacacagcc

SEQ ID NO: 66169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttagaaatattaacacag

SEQ ID NO: 66170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttttagaaatattaaca

SEQ ID NO: 66171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcttttagaaatattaac

SEQ ID NO: 66172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggtttattcttttagaaa

SEQ ID NO: 66173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggctataggtttattcttt

SEQ ID NO: 66174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggctataggtttattctt

SEQ ID NO: 66175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaggctataggtttattct

SEQ ID NO: 66176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatattttcaggctatagg

SEQ ID NO: 66177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catatattttcaggctatag

SEQ ID NO: 66178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcttcatatattttcaggc

SEQ ID NO: 66179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaagcttcatatattttca

SEQ ID NO: 66180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaagcttcatatattttc

SEQ ID NO: 66181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttaagcttcatatatttt

SEQ ID NO: 66182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttgttaagcttcatata

SEQ ID NO: 66183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttgttaagcttcatat

SEQ ID NO: 66184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattttgttaagcttcata

SEQ ID NO: 66185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatattttaattttgttaa

SEQ ID NO: 66186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catattatcatattttaatt

SEQ ID NO: 66187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgcatattatcatatttta

SEQ ID NO: 66188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accactattgcatattatca

SEQ ID NO: 66189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caccactattgcatattatc

SEQ ID NO: 66190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaaaaaaccttcaccacta

SEQ ID NO: 66191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgttgtgaaaaaaccttc

SEQ ID NO: 66192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtgtgttgtgaaaaaacc

SEQ ID NO: 66193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgtgtgttgtgaaaaaac

SEQ ID NO: 66194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttactgtgtgttgtgaaaaa

SEQ ID NO: 66195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttactgtgtgttgtgaa

SEQ ID NO: 66196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcttactgtgtgttgtga

SEQ ID NO: 66197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagaggatttattcttact

SEQ ID NO: 66198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagaggatttattcttac

SEQ ID NO: 66199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaagaggatttattctta

SEQ ID NO: 66200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtacattttaaaagaggat

SEQ ID NO: 66201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtacattttaaaagagga

SEQ ID NO: 66202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagtacattttaaaagagg

SEQ ID NO: 66203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgagtacattttaaaagag

SEQ ID NO: 66204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtaggtacttttgagtac

SEQ ID NO: 66205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgatgtaggtacttttgag

SEQ ID NO: 66206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attgttgatgtaggtacttt

SEQ ID NO: 66207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaattgttgatgtaggtac

SEQ ID NO: 66208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctaattgttgatgtaggta

SEQ ID NO: 66209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatttcctaattgttgatgt

SEQ ID NO: 66210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctggatttcctaattgttg

SEQ ID NO: 66211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgttggctggatttcctaa

SEQ ID NO: 66212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accaatgcctggtgttggct

SEQ ID NO: 66213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccaatgcctggtgttggc

SEQ ID NO: 66214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaacatatttcaccaatg

SEQ ID NO: 66215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatggatagcatatggtta

SEQ ID NO: 66216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaatggatagcatatggt

SEQ ID NO: 66217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaaaatggatagcatatgg

SEQ ID NO: 66218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaatgcttctaaaatggat

SEQ ID NO: 66219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaaatgcttctaaaatgg

SEQ ID NO: 66220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attctggaaatgcttctaaa

SEQ ID NO: 66221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattctggaaatgcttctaa

SEQ ID NO: 66222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catcttcattctggaaatgc

SEQ ID NO: 66223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatcttcattctggaaatg

SEQ ID NO: 66224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttacatcttcattctgga

SEQ ID NO: 66225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacttacatcttcattctgg

SEQ ID NO: 66226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtatgcagacaagatctt

SEQ ID NO: 66227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctggagtatgcagacaag

SEQ ID NO: 66228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agattatcctggagtatgca

SEQ ID NO: 66229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaggaaaaagaccattaag

SEQ ID NO: 66230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattgaaaggaaaaagacca

SEQ ID NO: 66231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattgaaaggaaaaagacc

SEQ ID NO: 66232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagatatttatattgaaagg

SEQ ID NO: 66233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagatatttatattgaaag

SEQ ID NO: 66234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagatatttatattgaaa

SEQ ID NO: 66235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaagatatttatattgaa

SEQ ID NO: 66236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacaggcttttgaagatatt

SEQ ID NO: 66237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacaggcttttgaagatat

SEQ ID NO: 66238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttccacaggcttttgaaga

SEQ ID NO: 66239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatattatttccacaggctt

SEQ ID NO: 66240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatattatttccacaggct

SEQ ID NO: 66241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaacttgaatattatttcca

SEQ ID NO: 66242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcatgattgaaacttgaat

SEQ ID NO: 66243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttgtgcatgattgaaact

SEQ ID NO: 66244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagttgtgcatgattgaaac

SEQ ID NO: 66245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgaatcatgaagcttaag

SEQ ID NO: 66246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgaatcatgaagcttaa

SEQ ID NO: 66247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatgaatcatgaagctta

SEQ ID NO: 66248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatgaatcatgaagctt

SEQ ID NO: 66249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaatgaatcatgaagct

SEQ ID NO: 66250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaatgaatcatgaagc

SEQ ID NO: 66251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaaatgaatcatgaag

SEQ ID NO: 66252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttttttaaatgaatcatg

SEQ ID NO: 66253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgttttttttaaatgaatc

SEQ ID NO: 66254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgttttttttaaatgaat

SEQ ID NO: 66255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgttttttttaaatgaa

SEQ ID NO: 66256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcctgttttttttaaatga

SEQ ID NO: 66257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttcctgtttttttta

SEQ ID NO: 66258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaattgtatttttcctgttt

SEQ ID NO: 66259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcattagaattgtatttttc

SEQ ID NO: 66260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcattagaattgtattttt

SEQ ID NO: 66261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcagtcttagcattagaat

SEQ ID NO: 66262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcagtcttagcattagaa

SEQ ID NO: 66263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtttcagcagtcttagcat

SEQ ID NO: 66264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcccatgtcaatattatgtt

SEQ ID NO: 66265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaaccagaaaaaatgtcag

SEQ ID NO: 66266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgataactgtaaaccaga

SEQ ID NO: 66267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatatgataactgtaaacc

SEQ ID NO: 66268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actgttatatgataactgta

SEQ ID NO: 66269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaactaactgttatatgata

SEQ ID NO: 66270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgagaaggctagaactaac

SEQ ID NO: 66271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagaccagcagcagcactgg

SEQ ID NO: 66272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaagaccagcagcagcact

SEQ ID NO: 66273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acctctgaagaccagcagca

SEQ ID NO: 66274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacctctgaagaccagcagc

SEQ ID NO: 66275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgacctctgaagaccagca

SEQ ID NO: 66276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttgacctctgaagaccag

SEQ ID NO: 66277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttgacctctgaagacca

SEQ ID NO: 66278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcttgacctctgaagacc

SEQ ID NO: 66279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cactttctcttgacctctga

SEQ ID NO: 66280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcactttctcttgacctctg

SEQ ID NO: 66281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcactttctcttgacctct

SEQ ID NO: 66282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgcactttctcttgacctc

SEQ ID NO: 66283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgcactttctcttgacc

SEQ ID NO: 66284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcttttgcactttctctt

SEQ ID NO: 66285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattcttttgcactttctct

SEQ ID NO: 66286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagtaatttcattcttttg

SEQ ID NO: 66287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggattataagtaatttcat

SEQ ID NO: 66288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggattataagtaatttca

SEQ ID NO: 66289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtggattataagtaatttc

SEQ ID NO: 66290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtggattataagtaattt

SEQ ID NO: 66291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgtggattataagtaatt

SEQ ID NO: 66292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggagaaagaggaggaatc

SEQ ID NO: 66293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatggagaaagaggaggaat

SEQ ID NO: 66294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatggagaaagaggaggaa

SEQ ID NO: 66295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccaattttaatggagaaag

SEQ ID NO: 66296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atccaattttaatggagaaa

SEQ ID NO: 66297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggacttatccaattttaatg

SEQ ID NO: 66298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaggacttatccaatttta

SEQ ID NO: 66299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgctaggacttatccaa

SEQ ID NO: 66300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaattgctaggacttatcca

SEQ ID NO: 66301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccatgggatcatgtcttaa

SEQ ID NO: 66302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taacagtggctggccatggg

SEQ ID NO: 66303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataacagtggctggccatgg

SEQ ID NO: 66304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtggggaaaaaggggagtgt

SEQ ID NO: 66305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctggtggggaaaaaggggag

SEQ ID NO: 66306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacatcctactggtggggaa

SEQ ID NO: 66307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagacaggctccacatcct

SEQ ID NO: 66308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagctgaaagacaggctcc

SEQ ID NO: 66309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagagctgaaagacaggctc

SEQ ID NO: 66310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggatgcacaagcatttgaga

SEQ ID NO: 66311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcactgggatgcacaagca

SEQ ID NO: 66312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatggtactaggcactggg

SEQ ID NO: 66313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaacatggtactaggcact

SEQ ID NO: 66314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttattaacatggtactaggc

SEQ ID NO: 66315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgttattaacatggtacta

SEQ ID NO: 66316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgctgttattaacatggta

SEQ ID NO: 66317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgctgctgttattaacatg

SEQ ID NO: 66318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgctgctgttattaacat

SEQ ID NO: 66319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctgctgctgttattaaca

SEQ ID NO: 66320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttcctgctgctgttatta

SEQ ID NO: 66321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttcctgctgctgttatt

SEQ ID NO: 66322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctttcctgctgctgttat

SEQ ID NO: 66323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaaatctttcctttcctgc

SEQ ID NO: 66324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcaaatctttcctttcctg

SEQ ID NO: 66325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttagcaaatctttccttt

SEQ ID NO: 66326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagtcattcatttagcaaat

SEQ ID NO: 66327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgcagtcattcatttagca

SEQ ID NO: 66328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agctactgcagtcattcatt

SEQ ID NO: 66329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaagctactgcagtcattc

SEQ ID NO: 66330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggcctattaagctactgc

SEQ ID NO: 66331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataggcctattaagctact

SEQ ID NO: 66332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttctataggcctattaag

SEQ ID NO: 66333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtgttctataggcctatta

SEQ ID NO: 66334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggataatatatggatgaa

SEQ ID NO: 66335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaggataatatatggatga

SEQ ID NO: 66336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaaggataatatatggatg

SEQ ID NO: 66337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagctttgaaggataatata

SEQ ID NO: 66338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagctgaagctttgaaggat

SEQ ID NO: 66339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagctgaagctttgaagga

SEQ ID NO: 66340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagagctgaagctttgaagg

SEQ ID NO: 66341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagagctgaagctttgaag

SEQ ID NO: 66342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggagagaatagaacagtg

SEQ ID NO: 66343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaagcataggaagcaccgc

SEQ ID NO: 66344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaaagcataggaagcaccg

SEQ ID NO: 66345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggaaagcataggaagcac

SEQ ID NO: 66346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttggaaagcataggaagca

SEQ ID NO: 66347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatttcttggaaagcatag

SEQ ID NO: 66348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaaaatttcttggaaagca

SEQ ID NO: 66349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actaaaatttcttggaaagc

SEQ ID NO: 66350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgtcacttactaaaattt

SEQ ID NO: 66351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcacataatgttgtgtgtca

SEQ ID NO: 66352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgttgtcacataatgttgt

SEQ ID NO: 66353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acctaatgttgtcacataat

SEQ ID NO: 66354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatagagctcacctaatgtt

SEQ ID NO: 66355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattagatagagctcaccta

SEQ ID NO: 66356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaacagtaaagcgtaagcc

SEQ ID NO: 66357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agacagaagagcatacacaa

SEQ ID NO: 66358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcagacagaagagcataca

SEQ ID NO: 66359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggctcctcagacagaagag

SEQ ID NO: 66360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttgtggctcctcagacag

SEQ ID NO: 66361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgtgttgtggctcctcag

SEQ ID NO: 66362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactgtgttgtggctcctca

SEQ ID NO: 66363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcactgtgttgtggctcctc

SEQ ID NO: 66364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcctttcactgtgttgtggc

SEQ ID NO: 66365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagtcaaagtcaccctgtcc

SEQ ID NO: 66366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagtctaaagtcaaagtcac

SEQ ID NO: 66367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaagggacatgtggctgaa

SEQ ID NO: 66368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcaagggacatgtggctga

SEQ ID NO: 66369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtcaagggacatgtggctg

SEQ ID NO: 66370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgtcaagggacatgtggc

SEQ ID NO: 66371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaattctttgtcaagggaca

SEQ ID NO: 66372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaattctttgtcaagggac

SEQ ID NO: 66373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaattctttgtcaaggga

SEQ ID NO: 66374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtcctttcaaattctttgt

SEQ ID NO: 66375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtcctttcaaattctttg

SEQ ID NO: 66376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtcctttcaaattcttt

SEQ ID NO: 66377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcagtcctttcaaattctt

SEQ ID NO: 66378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caacaatgagcccaattttt

SEQ ID NO: 66379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgcaacaatgagcccaat

SEQ ID NO: 66380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcactgcaacaatgagcc

SEQ ID NO: 66381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggctcactgcaacaatgagc

SEQ ID NO: 66382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtgcagtggcgtgatctt

SEQ ID NO: 66383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccaggctggagtgcagtgg

SEQ ID NO: 66384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgcccaggctggagtgcag

SEQ ID NO: 66385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttgcccaggctggagtgc

SEQ ID NO: 66386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctgttgcccaggctggag

SEQ ID NO: 66387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctctgttgcccaggctgga

SEQ ID NO: 66388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacagagtcttgctctgtt

SEQ ID NO: 66389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagacagagtcttgctctgt

SEQ ID NO: 66390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagacagagtcttgctctg

SEQ ID NO: 66391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagacagagtcttgctct

SEQ ID NO: 66392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagacagagtcttgctc

SEQ ID NO: 66393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgagacagagtcttgct

SEQ ID NO: 66394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgagacagagtcttgc

SEQ ID NO: 66395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgagacagagtcttg

SEQ ID NO: 66396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttgagacagagtctt

SEQ ID NO: 66397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttgagacagagtct

SEQ ID NO: 66398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttgagacagagtc

SEQ ID NO: 66399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttgagacagagt

SEQ ID NO: 66400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttgagacagag

SEQ ID NO: 66401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttgagacaga

SEQ ID NO: 66402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttgagacag

SEQ ID NO: 66403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttgagaca

SEQ ID NO: 66404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttgagac

SEQ ID NO: 66405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttttgaga

SEQ ID NO: 66406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttgag

SEQ ID NO: 66407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttttttttttttttga

SEQ ID NO: 66408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatgagcctttttttttttt

SEQ ID NO: 66409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgtctcaatgagcctttt

SEQ ID NO: 66410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtgtctcaatgagccttt

SEQ ID NO: 66411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtgtctcaatgagcctt

SEQ ID NO: 66412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatcagcaatcattttcag

SEQ ID NO: 66413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgagatcagcaatcatttt

SEQ ID NO: 66414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacctgttgagatcagcaat

SEQ ID NO: 66415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agacctgttgagatcagcaa

SEQ ID NO: 66416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagacctgttgagatcagca

SEQ ID NO: 66417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acactttagacctgttgaga

SEQ ID NO: 66418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taacactttagacctgttga

SEQ ID NO: 66419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagagaaagttctaacact

SEQ ID NO: 66420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gatctgaaagagaaagttct

SEQ ID NO: 66421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgatctgaaagagaaagttc

SEQ ID NO: 66422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagtgtttcgatctgaaag

SEQ ID NO: 66423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccaacagggttaatagtgt

SEQ ID NO: 66424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccaacagggttaatagtg

SEQ ID NO: 66425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatccaacagggttaatagt

SEQ ID NO: 66426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttatccaacagggttaa

SEQ ID NO: 66427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattttatccaacagggtta

SEQ ID NO: 66428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcattttatccaacagggtt

SEQ ID NO: 66429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttcattttatccaacag

SEQ ID NO: 66430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactttcattttatccaaca

SEQ ID NO: 66431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgactttcattttatccaac

SEQ ID NO: 66432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accacgaaggatacaggtct

SEQ ID NO: 66433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagacaggtaataaatataa

SEQ ID NO: 66434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgactgtagacaggtaata

SEQ ID NO: 66435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatggcacaagttcatgact

SEQ ID NO: 66436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagcagaacgtagaataag

SEQ ID NO: 66437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagtattgaaagcagaacgt

SEQ ID NO: 66438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagtattgaaagcagaacg

SEQ ID NO: 66439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagagtattgaaagcagaac

SEQ ID NO: 66440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggataattttagagtattg

SEQ ID NO: 66441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctaaggataattttagagta

SEQ ID NO: 66442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaaaactgctaaggataat

SEQ ID NO: 66443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccaaaactgctaaggataa

SEQ ID NO: 66444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataccaacagtttcccaaaa

SEQ ID NO: 66445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatattgataccaacagttt

SEQ ID NO: 66446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caatattgataccaacagtt

SEQ ID NO: 66447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcaatattgataccaacag

SEQ ID NO: 66448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcaatattgataccaaca

SEQ ID NO: 66449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttcaatattgataccaac

SEQ ID NO: 66450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttcaatattgataccaa

SEQ ID NO: 66451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttcttcaatattgatacc

SEQ ID NO: 66452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctcttttcttcaatattga

SEQ ID NO: 66453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtctcttttcttcaatattg

SEQ ID NO: 66454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccccaacttgtctcttttct

SEQ ID NO: 66455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgccccaacttgtctctttt

SEQ ID NO: 66456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgccccaacttgtctcttt

SEQ ID NO: 66457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgccccaacttgtctctt

SEQ ID NO: 66458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtctttctgccccaacttg

SEQ ID NO: 66459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaggtccattcagtctttc

SEQ ID NO: 66460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtaggtccattcagtcttt

SEQ ID NO: 66461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catcttagtaggtccattca

SEQ ID NO: 66462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatcttagtaggtccattc

SEQ ID NO: 66463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcatcttagtaggtccatt

SEQ ID NO: 66464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcatcttagtaggtccat

SEQ ID NO: 66465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgcatcttagtaggtcca

SEQ ID NO: 66466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttgcatcttagtaggtc

SEQ ID NO: 66467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttttgcatcttagtaggt

SEQ ID NO: 66468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaccttctttttgcatctt

SEQ ID NO: 66469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgggaccttctttttgcat

SEQ ID NO: 66470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaactgctgggaccttctt

SEQ ID NO: 66471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgccaactgctgggaccttc

SEQ ID NO: 66472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaacctctgccaactgctg

SEQ ID NO: 66473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaacctctgccaactgct

SEQ ID NO: 66474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatttcagaacctctgccaa

SEQ ID NO: 66475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattgaatttcagaacctct

SEQ ID NO: 66476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattccattgaatttcagaa

SEQ ID NO: 66477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caattccattgaatttcaga

SEQ ID NO: 66478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacttcaattccattgaatt

SEQ ID NO: 66479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcacttcaattccattgaa

SEQ ID NO: 66480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctctgcacttcaattccat

SEQ ID NO: 66481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaagcctccctctgcacttc

SEQ ID NO: 66482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agggctagaagcctccctct

SEQ ID NO: 66483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggggtggagtggaggggagg

SEQ ID NO: 66484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggggtggagtggaggggag

SEQ ID NO: 66485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagaatttgggggtggagtg

SEQ ID NO: 66486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctccagaatttgggggtgga

SEQ ID NO: 66487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attcctccagaatttggggg

SEQ ID NO: 66488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctgattcctccagaatttg

SEQ ID NO: 66489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcctgattcctccagaattt

SEQ ID NO: 66490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatggcttgcctgattcctc

SEQ ID NO: 66491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatggcttgcctgattcct

SEQ ID NO: 66492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggtttagatggcttgcctga

SEQ ID NO: 66493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cggtttagatggcttgcctg

SEQ ID NO: 66494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatagtttcggtttagatg

SEQ ID NO: 66495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtcattgccatagtttcgg

SEQ ID NO: 66496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggactgagtcattgccat

SEQ ID NO: 66497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaggactgagtcattgcca

SEQ ID NO: 66498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttcaaggactgagtcat

SEQ ID NO: 66499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttcaaggactgagtca

SEQ ID NO: 66500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtatttcaaggactgagtc

SEQ ID NO: 66501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctttgtatttcaaggactg

SEQ ID NO: 66502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtctttgtatttcaaggact

SEQ ID NO: 66503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgtctttgtatttcaagg

SEQ ID NO: 66504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttgtctttgtatttcaag

SEQ ID NO: 66505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agccccttccttgtctttgt

SEQ ID NO: 66506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgactaagccccttccttgt

SEQ ID NO: 66507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgactaagccccttccttg

SEQ ID NO: 66508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgtgactaagccccttcc

SEQ ID NO: 66509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttgtgactaagccccttc

SEQ ID NO: 66510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttgtgactaagcccctt

SEQ ID NO: 66511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gttttccttgtgactaagcc

SEQ ID NO: 66512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgttttccttgtgactaagc

SEQ ID NO: 66513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaacaggcttcgttttcct

SEQ ID NO: 66514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagaaacaggcttcgttttc

SEQ ID NO: 66515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacaccagttctagaaacag

SEQ ID NO: 66516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
accctgtacaccagttctag

SEQ ID NO: 66517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaccctgtacaccagttct

SEQ ID NO: 66518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctctgaccctgtacaccagt

SEQ ID NO: 66519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctctgaccctgtacacca

SEQ ID NO: 66520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cggctctgctctgaccctgt

SEQ ID NO: 66521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgcggctctgctctgaccc

SEQ ID NO: 66522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgcggctctgctctgacc

SEQ ID NO: 66523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcatcaagacttcctgcgg

SEQ ID NO: 66524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatcatcaagacttcctgc

SEQ ID NO: 66525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaccagtcagagagaggtt

SEQ ID NO: 66526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgggaccagtcagagagagg

SEQ ID NO: 66527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctctgggaccagtcagagag

SEQ ID NO: 66528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgctctgggaccagtcaga

SEQ ID NO: 66529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attcctgctctgggaccagt

SEQ ID NO: 66530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taattcctgctctgggacca

SEQ ID NO: 66531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattctaattcctgctctgg

SEQ ID NO: 66532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgggctgaattctaattcct

SEQ ID NO: 66533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaacccctgtgggctgaatt

SEQ ID NO: 66534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagctagaacccctgtggg

SEQ ID NO: 66535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaagctagaacccctgtg

SEQ ID NO: 66536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttctggaagctagaacccc

SEQ ID NO: 66537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catccacaaaattggttctg

SEQ ID NO: 66538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctacatccacaaaattggtt

SEQ ID NO: 66539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcctacatccacaaaattg

SEQ ID NO: 66540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctcctacatccacaaaatt

SEQ ID NO: 66541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttgctcctacatccacaaa

SEQ ID NO: 66542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctccttgctcctacatcca

SEQ ID NO: 66543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcctccttgctcctacatcc

SEQ ID NO: 66544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgcctccttgctcctacat

SEQ ID NO: 66545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acataaggtcattcttgcct

SEQ ID NO: 66546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatcagatagagctcacata

SEQ ID NO: 66547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtcctaaatcagatagagc

SEQ ID NO: 66548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaacagtaaagcgttaagt

SEQ ID NO: 66549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtaacagtaaagcgttaag

SEQ ID NO: 66550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatttagtaacagtaaagcg

SEQ ID NO: 66551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaaagaagagtatacacaa

SEQ ID NO: 66552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcagaaagaagagtataca

SEQ ID NO: 66553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggctcctcagaaagaagag

SEQ ID NO: 66554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttgtggctcctcagaaag

SEQ ID NO: 66555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgtgttgtggctcctcag

SEQ ID NO: 66556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactgtgttgtggctcctca

SEQ ID NO: 66557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcactgtgttgtggctcctc

SEQ ID NO: 66558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcactgtgttgtggctcct

SEQ ID NO: 66559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatcaaagtcaccatatct

SEQ ID NO: 66560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatctaaaatcaaagtcac

SEQ ID NO: 66561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattgacatctaaaatcaaa

SEQ ID NO: 66562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcactgaattgacatctaaa

SEQ ID NO: 66563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtaaatgacagagctatcac

SEQ ID NO: 66564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtcccaaagctagtaaat

SEQ ID NO: 66565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatgtcccaaagctagtaaa

SEQ ID NO: 66566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttaatgtcccaaagctagt

SEQ ID NO: 66567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagttgcttaatgtcccaa

SEQ ID NO: 66568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagttgcttaatgtccca

SEQ ID NO: 66569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaagttgcttaatgtccc

SEQ ID NO: 66570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtacagttttaaaagttgc

SEQ ID NO: 66571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaatgatgaagctgggtac

SEQ ID NO: 66572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accaatgatgaagctgggta

SEQ ID NO: 66573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taccaatgatgaagctgggt

SEQ ID NO: 66574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaccaatgatgaagctg

SEQ ID NO: 66575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttaccaatgatgaagct

SEQ ID NO: 66576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttattttaccaatgatgaa

SEQ ID NO: 66577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttattttaccaatgatga

SEQ ID NO: 66578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcttattttaccaatgatg

SEQ ID NO: 66579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatattttgcttattttac

SEQ ID NO: 66580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgagattatgatattttgct

SEQ ID NO: 66581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaacaaccctgtgagattat

SEQ ID NO: 66582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaacaaccctgtgagatta

SEQ ID NO: 66583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaacaaccctgtgagatt

SEQ ID NO: 66584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttcaaacaaccctgtga

SEQ ID NO: 66585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttcaaacaaccctgtg

SEQ ID NO: 66586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttaattttcaaacaaccc

SEQ ID NO: 66587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatttaattttcaaacaac

SEQ ID NO: 66588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcatttaattttcaaacaa

SEQ ID NO: 66589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcatttaattttcaaaca

SEQ ID NO: 66590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gattttctcatttaattttc

SEQ ID NO: 66591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agattttctcatttaatttt

SEQ ID NO: 66592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagattttctcatttaattt

SEQ ID NO: 66593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagattttctcatttaatt

SEQ ID NO: 66594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttagattttctcatttaa

SEQ ID NO: 66595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttagattttctcattta

SEQ ID NO: 66596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaatcttcttttagatttt

SEQ ID NO: 66597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaatcttcttttagattt

SEQ ID NO: 66598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttcagaatcttctttta

SEQ ID NO: 66599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtgtttcagaatcttctt

SEQ ID NO: 66600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgtgtttcagaatcttct

SEQ ID NO: 66601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacttattgtgtttcagaat

SEQ ID NO: 66602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atacttattgtgtttcagaa

SEQ ID NO: 66603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcttatacttattgtgtttc

SEQ ID NO: 66604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcttatacttattgtgttt

SEQ ID NO: 66605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttagcttatacttattgt

SEQ ID NO: 66606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatttagcttatacttatt

SEQ ID NO: 66607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagaagtaatagctctca

SEQ ID NO: 66608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaataaaagttaaaaagaag

SEQ ID NO: 66609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaacctaaaataaaagttaa

SEQ ID NO: 66610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatgtaccctcaaacctaa

SEQ ID NO: 66611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacatgtaccctcaaaccta

SEQ ID NO: 66612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtaacaaaccttcacatgt

SEQ ID NO: 66613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctatgtaacaaaccttcac

SEQ ID NO: 66614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctatgtaacaaaccttca

SEQ ID NO: 66615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtatagcaaacccccat

SEQ ID NO: 66616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagtatagcaaaccccca

SEQ ID NO: 66617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaagtatagcaaaccccc

SEQ ID NO: 66618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaagtatagcaaacccc

SEQ ID NO: 66619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaagtatagcaaaccc

SEQ ID NO: 66620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gattttttaaaagtatagca

SEQ ID NO: 66621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactagattttttaaaagta

SEQ ID NO: 66622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaattaaactagatttttt

SEQ ID NO: 66623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacaggttgccaattaaact

SEQ ID NO: 66624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agacaggttgccaattaaac

SEQ ID NO: 66625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacttagacaggttgccaat

SEQ ID NO: 66626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacttagacaggttgccaa

SEQ ID NO: 66627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgtttgtacttagacaggt

SEQ ID NO: 66628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagaagctggtgtttgtact

SEQ ID NO: 66629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagaagctggtgtttgtac

SEQ ID NO: 66630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataaatcatatgaggaaga

SEQ ID NO: 66631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaataaatcatatgaggaag

SEQ ID NO: 66632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaataaatcatatgaggaa

SEQ ID NO: 66633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaagtgtattttaaataaa

SEQ ID NO: 66634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaaagtgtattttaaata

SEQ ID NO: 66635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggagggcattctcaaaagt

SEQ ID NO: 66636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggggagggcattctcaaaag

SEQ ID NO: 66637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaacagaggaagacatttgg

SEQ ID NO: 66638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatgtctaaaacagagga

SEQ ID NO: 66639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcaaaatgtctaaaacaga

SEQ ID NO: 66640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttcaaaatgtctaaaacag

SEQ ID NO: 66641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgttcaaaatgtctaaaa

SEQ ID NO: 66642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagtaattccttgttcaaaa

SEQ ID NO: 66643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggagtaattccttgttcaaa

SEQ ID NO: 66644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtttggagtaattccttg

SEQ ID NO: 66645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaaaaattaaagtttgga

SEQ ID NO: 66646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagaggagattacaaaaaa

SEQ ID NO: 66647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagagaggagattacaaaaa

SEQ ID NO: 66648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaatttcagagaggagatt

SEQ ID NO: 66649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acatatgtgactgagaattt

SEQ ID NO: 66650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actcacatatgtgactgaga

SEQ ID NO: 66651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcccatgctgactcacatat

SEQ ID NO: 66652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcccatgctgactcacata

SEQ ID NO: 66653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggaggtttatcccatgctg

SEQ ID NO: 66654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtaactaaggaggtttatcc

SEQ ID NO: 66655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctagtaactaaggaggttta

SEQ ID NO: 66656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccatgcaatgtattcctagt

SEQ ID NO: 66657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtcatccaagtagaaatc

SEQ ID NO: 66658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctggagtcatccaagtaga

SEQ ID NO: 66659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acctggagtcatccaagtag

SEQ ID NO: 66660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttacctggagtcatccaag

SEQ ID NO: 66661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttacctggagtcatccaa

SEQ ID NO: 66662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttacctggagtcatcca

SEQ ID NO: 66663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttccttacctggagtcat

SEQ ID NO: 66664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattttccttacctggagtc

SEQ ID NO: 66665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaaacagaaaatgtgatca

SEQ ID NO: 66666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcagaaacagaaaatgtgat

SEQ ID NO: 66667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aactctcagaaacagaaaat

SEQ ID NO: 66668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaagtctcaactctcagaa

SEQ ID NO: 66669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatcaagtctcaactctca

SEQ ID NO: 66670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctatcaagtctcaactctc

SEQ ID NO: 66671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctatcaagtctcaactct

SEQ ID NO: 66672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttcctatcaagtctcaac

SEQ ID NO: 66673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttcctatcaagtctcaa

SEQ ID NO: 66674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctttcctatcaagtctca

SEQ ID NO: 66675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggctttcctttcctatcaa

SEQ ID NO: 66676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagggacccactgtggcttt

SEQ ID NO: 66677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccaacaacctgcagggacc

SEQ ID NO: 66678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcacactccccaacaacctg

SEQ ID NO: 66679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcacactccccaacaacct

SEQ ID NO: 66680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggcacactccccaacaac

SEQ ID NO: 66681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcattcttggcacactcccc

SEQ ID NO: 66682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtaaggagcaggcagagcc

SEQ ID NO: 66683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggaatgtcctaggtaagga

SEQ ID NO: 66684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaacacaaccctgaggaat

SEQ ID NO: 66685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgcaaacacaaccctgag

SEQ ID NO: 66686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcactgcaaacacaaccct

SEQ ID NO: 66687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaggttgctcactgcaaaca

SEQ ID NO: 66688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgtctcaaggttgctcact

SEQ ID NO: 66689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctcatgtctcaaggttgct

SEQ ID NO: 66690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcccagagaccctacctcat

SEQ ID NO: 66691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcccagagaccctacctca

SEQ ID NO: 66692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtcccagagaccctacctc

SEQ ID NO: 66693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgtcccagagaccctacc

SEQ ID NO: 66694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctctttgtcccagagaccct

SEQ ID NO: 66695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taccaagcaacataagcaac

SEQ ID NO: 66696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataccaagcaacataagcaa

SEQ ID NO: 66697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataccaagcaacataagca

SEQ ID NO: 66698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttataccaagcaacataagc

SEQ ID NO: 66699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggaatgcatccttttatac

SEQ ID NO: 66700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agggaatgcatccttttata

SEQ ID NO: 66701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcttagggaatgcatcctt

SEQ ID NO: 66702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggaacactgagcttaggga

SEQ ID NO: 66703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtcacagctgaggaacac

SEQ ID NO: 66704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatgagtgtgtacacatata

SEQ ID NO: 66705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgagcctgaatgagtgtg

SEQ ID NO: 66706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgggggcattatatgagcc

SEQ ID NO: 66707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccaggtctcatgggggcat

SEQ ID NO: 66708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acccaggtctcatgggggca

SEQ ID NO: 66709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacccaggtctcatgggggc

SEQ ID NO: 66710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccctttacccaggtctcat

SEQ ID NO: 66711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttccccctttacccaggtc

SEQ ID NO: 66712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttggttccccctttacccag

SEQ ID NO: 66713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttggttccccctttaccc

SEQ ID NO: 66714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgttggttccccctttacc

SEQ ID NO: 66715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacatgtttctgttggttcc

SEQ ID NO: 66716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacatgtttctgttggttc

SEQ ID NO: 66717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgtggaaagtagcatgag

SEQ ID NO: 66718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgtgtggaaagtagcatga

SEQ ID NO: 66719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttatgtgtggaaagtagca

SEQ ID NO: 66720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttacttatgtgtggaaagta

SEQ ID NO: 66721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttacttatgtgtggaaagt

SEQ ID NO: 66722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttacttatgtgtggaaag

SEQ ID NO: 66723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtcagagataaaggacttt

SEQ ID NO: 66724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggtcagagataaaggactt

SEQ ID NO: 66725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcagaagatatgaggtgctt

SEQ ID NO: 66726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atggatgctggcagaagata

SEQ ID NO: 66727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catggatgctggcagaagat

SEQ ID NO: 66728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttcatggatgctggcagaa

SEQ ID NO: 66729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atactgtttcatggatgctg

SEQ ID NO: 66730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atctgatactgtttcatgga

SEQ ID NO: 66731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataggttgatctgatactgt

SEQ ID NO: 66732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgctaataggttgatctg

SEQ ID NO: 66733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatgctaataggttgatct

SEQ ID NO: 66734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacttatatgctaataggtt

SEQ ID NO: 66735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtacttatatgctaatag

SEQ ID NO: 66736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgtacttatatgctaata

SEQ ID NO: 66737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgtacttatatgctaat

SEQ ID NO: 66738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttactgtacttatatgc

SEQ ID NO: 66739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattttactgtacttatatg

SEQ ID NO: 66740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgattttactgtacttatat

SEQ ID NO: 66741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gactttgattttactgtact

SEQ ID NO: 66742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggactttgattttactgtac

SEQ ID NO: 66743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgagtttggactttgattt

SEQ ID NO: 66744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgagtttggactttgatt

SEQ ID NO: 66745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atagacagtcttcatgagtt

SEQ ID NO: 66746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctcatagacagtcttcatg

SEQ ID NO: 66747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcctcatagacagtcttcat

SEQ ID NO: 66748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taacttgcctcatagacagt

SEQ ID NO: 66749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaacttgcctcatagacag

SEQ ID NO: 66750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtaacttgcctcatagaca

SEQ ID NO: 66751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagaactttgtaacttgcct

SEQ ID NO: 66752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatagaatactcaagaac

SEQ ID NO: 66753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactaaaaatagaatactca

SEQ ID NO: 66754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attatactaaaaatagaata

SEQ ID NO: 66755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattatactaaaaatagaat

SEQ ID NO: 66756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagtttcattatactaaaa

SEQ ID NO: 66757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatataccactggaagtttc

SEQ ID NO: 66758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctagatataccactggaag

SEQ ID NO: 66759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagcccagatctagctaga

SEQ ID NO: 66760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagccattaggagcccaga

SEQ ID NO: 66761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acagagatgagccattagaa

SEQ ID NO: 66762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acgctgacagagatgagcca

SEQ ID NO: 66763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgacgctgacagagatgag

SEQ ID NO: 66764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgctgacgctgacagagat

SEQ ID NO: 66765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgctgacgctgacagaga

SEQ ID NO: 66766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgctgacgctgacagag

SEQ ID NO: 66767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcctgctgacgctgacaga

SEQ ID NO: 66768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatttttcctgctgacgct

SEQ ID NO: 66769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgtcatttttcctgctga

SEQ ID NO: 66770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattgtcatttttcctgctg

SEQ ID NO: 66771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaattgtcatttttcctgc

SEQ ID NO: 66772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaattgtcatttttcctg

SEQ ID NO: 66773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttaattgtcatttttcct

SEQ ID NO: 66774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttaattgtcatttttcc

SEQ ID NO: 66775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcttaattgtcatttttc

SEQ ID NO: 66776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacctttttcttaattgtca

SEQ ID NO: 66777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctgaacctttttcttaatt

SEQ ID NO: 66778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagctacctgaaccttttt

SEQ ID NO: 66779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtagaattacaagctacctg

SEQ ID NO: 66780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagagatctagtagaatta

SEQ ID NO: 66781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgagagttgaaagagatc

SEQ ID NO: 66782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatgagagttgaaagagat

SEQ ID NO: 66783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacacatacaagcagcttcc

SEQ ID NO: 66784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtacacatacaagcagcttc

SEQ ID NO: 66785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtacacatacaagcagct

SEQ ID NO: 66786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attcttgtacacatacaagc

SEQ ID NO: 66787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcattcttgtacacatacaa

SEQ ID NO: 66788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcattcttgtacacataca

SEQ ID NO: 66789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggataaaagtaggacaagtt

SEQ ID NO: 66790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggataaaagtaggacaagt

SEQ ID NO: 66791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggataaaagtaggacaag

SEQ ID NO: 66792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaaagggaaaacagatgg

SEQ ID NO: 66793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgttataaaaagggaaaa

SEQ ID NO: 66794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgtgttataaaaagggaaa

SEQ ID NO: 66795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaagcatcttgtgtgttat

SEQ ID NO: 66796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgaagcatcttgtgtgtta

SEQ ID NO: 66797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgagaaagcaaggtcagctt

SEQ ID NO: 66798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caagtgtggtgggaagaaga

SEQ ID NO: 66799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aactgcaagtgtggtgggaa

SEQ ID NO: 66800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgaactgcaagtgtggtgg

SEQ ID NO: 66801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaactgctgaactgcaagt

SEQ ID NO: 66802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggaaattaaaaactgctga

SEQ ID NO: 66803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggggaacaagtatacaatc

SEQ ID NO: 66804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcaaggcaggctgagggga

SEQ ID NO: 66805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttaggcaaggcaggctgag

SEQ ID NO: 66806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagttaggcaaggcaggctg

SEQ ID NO: 66807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagttaggcaaggcaggct

SEQ ID NO: 66808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctagttaggcaaggcaggc

SEQ ID NO: 66809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaagacgaacaggaatttt

SEQ ID NO: 66810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agggtctagaaagacgaaca

SEQ ID NO: 66811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagggtctagaaagacgaac

SEQ ID NO: 66812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagggtctagaaagacgaa

SEQ ID NO: 66813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcagggtctagaaagacga

SEQ ID NO: 66814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaacgtaaatggtgcttt

SEQ ID NO: 66815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaaacgtaaatggtgctt

SEQ ID NO: 66816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatttcagaaacgtaaatg

SEQ ID NO: 66817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcaatttcagaaacgtaaat

SEQ ID NO: 66818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttgcaatttcagaaacgta

SEQ ID NO: 66819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagcaaggagaacaactgct

SEQ ID NO: 66820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtagcaaggagaacaactg

SEQ ID NO: 66821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagcaaagtgtaaatgtga

SEQ ID NO: 66822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaagcaaagtgtaaatgtg

SEQ ID NO: 66823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgtgtttgtaagcaaagt

SEQ ID NO: 66824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggatgtgtttgtaagcaaag

SEQ ID NO: 66825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagagcttggatgtgtttgt

SEQ ID NO: 66826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagcaatggagaagagaag

SEQ ID NO: 66827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggagctcagagcaatggag

SEQ ID NO: 66828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaggagctcagagcaatgga

SEQ ID NO: 66829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaggagctcagagcaatg

SEQ ID NO: 66830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttaaggagctcagagca

SEQ ID NO: 66831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcttaaggagctcagagc

SEQ ID NO: 66832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttattcttaaggagctcag

SEQ ID NO: 66833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaatgcaaagataaataag

SEQ ID NO: 66834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacaatgcaaagataaataa

SEQ ID NO: 66835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcacaatgcaaagataaata

SEQ ID NO: 66836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatgatcaactttcacaatg

SEQ ID NO: 66837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatgatcaactttcacaat

SEQ ID NO: 66838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccaatttgtatgatcaact

SEQ ID NO: 66839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtaggacaagaactaccca

SEQ ID NO: 66840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttgagtaggacaagaacta

SEQ ID NO: 66841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttagttgagtaggacaagaa

SEQ ID NO: 66842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actgttagttgagtaggaca

SEQ ID NO: 66843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttgactgttagttgagtag

SEQ ID NO: 66844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agttgactgttagttgagta

SEQ ID NO: 66845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttagttgactgttagttgag

SEQ ID NO: 66846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actcttagttgactgttagt

SEQ ID NO: 66847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gactcttagttgactgttag

SEQ ID NO: 66848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgactcttagttgactgtt

SEQ ID NO: 66849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgactcttagttgactgt

SEQ ID NO: 66850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccttcttgactcttagttga

SEQ ID NO: 66851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccctgccttcttgactctt

SEQ ID NO: 66852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccctgccttcttgactct

SEQ ID NO: 66853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccccctgccttcttgactc

SEQ ID NO: 66854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccccctgccttcttgact

SEQ ID NO: 66855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agagcttttccccctgcctt

SEQ ID NO: 66856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taccctgagagcttttcccc

SEQ ID NO: 66857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaccctgagagcttttccc

SEQ ID NO: 66858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaccctgagagcttttcc

SEQ ID NO: 66859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagtaatgttttgtaccctg

SEQ ID NO: 66860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggagtaatgttttgtaccct

SEQ ID NO: 66861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggagtaatgttttgtacc

SEQ ID NO: 66862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattcttggagtaatgttt

SEQ ID NO: 66863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagagaattataattcttgg

SEQ ID NO: 66864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcagagaattataattcttg

SEQ ID NO: 66865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacagtcagtcttgcagaga

SEQ ID NO: 66866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caacagtcagtcttgcagag

SEQ ID NO: 66867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caacaagcagcttcaacagt

SEQ ID NO: 66868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagttacaacaagcagcttc

SEQ ID NO: 66869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagttacaacaagcagctt

SEQ ID NO: 66870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttcaagttacaacaagca

SEQ ID NO: 66871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagataaaactaatttcaag

SEQ ID NO: 66872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaagctatagataaaacta

SEQ ID NO: 66873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcagaagctatagataaaa

SEQ ID NO: 66874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcagaagctatagataaa

SEQ ID NO: 66875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagtgtaacaggtttcctca

SEQ ID NO: 66876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcctagagtgtaacaggtt

SEQ ID NO: 66877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcacaattagtcctagagtg

SEQ ID NO: 66878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcgagcaacagtcgttggca

SEQ ID NO: 66879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caactggcgagcaacagtcg

SEQ ID NO: 66880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtaagctccaactggcgagc

SEQ ID NO: 66881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggaactggtaagctccaac

SEQ ID NO: 66882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtaaggatctggggaactgg

SEQ ID NO: 66883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccctagtaaggatctgggg

SEQ ID NO: 66884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggccctagtaaggatct

SEQ ID NO: 66885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaagttcattggccctag

SEQ ID NO: 66886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaaagttcattggcccta

SEQ ID NO: 66887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagaaagttcattggccct

SEQ ID NO: 66888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgagaaagttcattggcc

SEQ ID NO: 66889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctttgagaaagttcattg

SEQ ID NO: 66890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatattgctctttgagaaag

SEQ ID NO: 66891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgggaaaatgttatata

SEQ ID NO: 66892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaaatgggaaaatgttat

SEQ ID NO: 66893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaaaatgggaaaatgtta

SEQ ID NO: 66894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattaaaatgggaaaatgtt

SEQ ID NO: 66895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaggttttattaaaatggga

SEQ ID NO: 66896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagaacaaagagagaaggtt

SEQ ID NO: 66897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgtagaacaaagagagaa

SEQ ID NO: 66898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctgtagaacaaagagaga

SEQ ID NO: 66899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccctgtagaacaaagagag

SEQ ID NO: 66900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagcactttccctgtagaa

SEQ ID NO: 66901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggcataaactgaaagcact

SEQ ID NO: 66902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaaacagggagagagtctg

SEQ ID NO: 66903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaaaacagggagagagtct

SEQ ID NO: 66904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaatatcagtttgcaaaac

SEQ ID NO: 66905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctggcaatatcagtttgcaa

SEQ ID NO: 66906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actggcaatatcagtttgca

SEQ ID NO: 66907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactggcaatatcagtttgc

SEQ ID NO: 66908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taatagaaaagagaatttta

SEQ ID NO: 66909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccaaaggaccacccagatg

SEQ ID NO: 66910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgtccaaaggaccacccag

SEQ ID NO: 66911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatgctgttgtccaaaggac

SEQ ID NO: 66912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccctgaatgctgttgtccaa

SEQ ID NO: 66913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgccctgaatgctgttgtc

SEQ ID NO: 66914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgccctgaatgctgttgt

SEQ ID NO: 66915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccttgctgccctgaatgct

SEQ ID NO: 66916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgccaggcattatccttg

SEQ ID NO: 66917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctacatgccaggcattatcc

SEQ ID NO: 66918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcactcctacatgccaggc

SEQ ID NO: 66919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgagcactcctacatgcca

SEQ ID NO: 66920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtaaatagttactgagcac

SEQ ID NO: 66921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agctcagtaaatagttactg

SEQ ID NO: 66922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagctcagtaaatagttact

SEQ ID NO: 66923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgagctcagtaaatagtt

SEQ ID NO: 66924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttgagctcagtaaatagt

SEQ ID NO: 66925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacttgagctcagtaaatag

SEQ ID NO: 66926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgccaatgacaaaatttta

SEQ ID NO: 66927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgattagtgccaatgacaaa

SEQ ID NO: 66928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atccctatgattagtgccaa

SEQ ID NO: 66929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaattaatccctatgattag

SEQ ID NO: 66930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctagaattaatccctatga

SEQ ID NO: 66931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctagaattaatccctatg

SEQ ID NO: 66932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacctagaattaatccctat

SEQ ID NO: 66933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttacctagaattaatccc

SEQ ID NO: 66934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagataaaaatatcatggc

SEQ ID NO: 66935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgagctaaaagataaaa

SEQ ID NO: 66936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatgagctaaaagataaa

SEQ ID NO: 66937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaatgagctaaaagataa

SEQ ID NO: 66938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaaaatgagctaaaagat

SEQ ID NO: 66939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtcaatattctttaaaatg

SEQ ID NO: 66940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attaagtcaatattctttaa

SEQ ID NO: 66941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtcaatatattgattaagt

SEQ ID NO: 66942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acacctaagtcaatatattg

SEQ ID NO: 66943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtaaatgatctgacacctaa

SEQ ID NO: 66944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcagtggtgccctggtaaa

SEQ ID NO: 66945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcagcagtggtgccctggt

SEQ ID NO: 66946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgatcctgctcagcagtgg

SEQ ID NO: 66947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcctcatgatcctgctcagc

SEQ ID NO: 66948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgtcctcatgatcctgct

SEQ ID NO: 66949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattgtcctcatgatcctgc

SEQ ID NO: 66950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagcttcattgtcctcatg

SEQ ID NO: 66951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagcttcattgtcctcat

SEQ ID NO: 66952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttgaaagcttcattgtcc

SEQ ID NO: 66953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacacagttggtttgaaagc

SEQ ID NO: 66954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgaacacagttggtttgaa

SEQ ID NO: 66955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caagattgttgaacacagtt

SEQ ID NO: 66956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctacaagattgttgaacaca

SEQ ID NO: 66957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtggaacatcaggaaaacct

SEQ ID NO: 66958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatagagtcagggaaagga

SEQ ID NO: 66959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaagttaacatagagtcag

SEQ ID NO: 66960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgctgccaagttaacatag

SEQ ID NO: 66961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatgctgccaagttaacat

SEQ ID NO: 66962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtatggaggttctcatgct

SEQ ID NO: 66963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaggttgtgtatggaggtt

SEQ ID NO: 66964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcaggttgtgtatggaggt

SEQ ID NO: 66965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtcaggttgtgtatggag

SEQ ID NO: 66966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgtcaggttgtgtatgga

SEQ ID NO: 66967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttgtcaggttgtgtatgg

SEQ ID NO: 66968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatgcatgtctttcttgtc

SEQ ID NO: 66969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacatgcatgtctttcttgt

SEQ ID NO: 66970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatatcaagatttaacatgc

SEQ ID NO: 66971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaatatcaagatttaacat

SEQ ID NO: 66972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctgaatatcaagatttaa

SEQ ID NO: 66973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctgaatatcaagattta

SEQ ID NO: 66974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttattctgaatatcaagat

SEQ ID NO: 66975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttattctgaatatcaaga

SEQ ID NO: 66976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttattctgaatatcaag

SEQ ID NO: 66977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaattttatttattctgaa

SEQ ID NO: 66978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataatgtattaaaaatttt

SEQ ID NO: 66979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattaaataatgtattaaaa

SEQ ID NO: 66980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcattaaataatgtattaaa

SEQ ID NO: 66981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agggagtatcacagaaagca

SEQ ID NO: 66982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttgagggagtatcacagaa

SEQ ID NO: 66983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttgagggagtatcacaga

SEQ ID NO: 66984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttggttgagggagtatcac

SEQ ID NO: 66985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaattatttggttgagggag

SEQ ID NO: 66986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caagtataggtgttgaaatt

SEQ ID NO: 66987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaattgcaagtataggtgtt

SEQ ID NO: 66988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctgaaattgcaagtatagg

SEQ ID NO: 66989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatctatctgaaattgcaag

SEQ ID NO: 66990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagatgaaggaaggcagca

SEQ ID NO: 66991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaacatcatgcaaagtta

SEQ ID NO: 66992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaaacatcatgcaaagtt

SEQ ID NO: 66993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttagaaaacatcatgcaaa

SEQ ID NO: 66994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acaactatttagaaaacatc

SEQ ID NO: 66995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actaacaactatttagaaaa

SEQ ID NO: 66996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaactaactaacaactattt

SEQ ID NO: 66997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagctaaaactaactaaca

SEQ ID NO: 66998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagaagacaagaatacattg

SEQ ID NO: 66999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggattacagaagacaagaa

SEQ ID NO: 67000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagagaaattggggattaca

SEQ ID NO: 67001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggaggagactgaagagaaa

SEQ ID NO: 67002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagactgtggaggagactga

SEQ ID NO: 67003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagactgtggaggagactg

SEQ ID NO: 67004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acacataaaatgaaagtggt

SEQ ID NO: 67005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcacacataaaatgaaag

SEQ ID NO: 67006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcattcacacataaaatg

SEQ ID NO: 67007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcattcattcacacataa

SEQ ID NO: 67008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttcattcattcattcacac

SEQ ID NO: 67009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttcattcattcattcaca

SEQ ID NO: 67010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagttcattcattcattcac

SEQ ID NO: 67011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agattttagttcattcattc

SEQ ID NO: 67012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagattttagttcattcatt

SEQ ID NO: 67013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtcgtcttcagattttag

SEQ ID NO: 67014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaattcatgtcgtcttcaga

SEQ ID NO: 67015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcagaaaagaagaccctaaa

SEQ ID NO: 67016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgtcagaaaagaagaccc

SEQ ID NO: 67017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctgtcagaaaagaagacc

SEQ ID NO: 67018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaaaatttatctgtcagaa

SEQ ID NO: 67019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagactagaaaaatttatct

SEQ ID NO: 67020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaattatagactagaaaaat

SEQ ID NO: 67021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatagaggagtggaagtat

SEQ ID NO: 67022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accatagaggagtggaagta

SEQ ID NO: 67023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taccatagaggagtggaagt

SEQ ID NO: 67024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaccatagaggagtggaag

SEQ ID NO: 67025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagggtttttaccatagag

SEQ ID NO: 67026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagagggtttttaccataga

SEQ ID NO: 67027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaggtgtatttcagaggg

SEQ ID NO: 67028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaaggtgtatttcagagg

SEQ ID NO: 67029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttagaaaggtgtatttcag

SEQ ID NO: 67030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatattgtttagaaaggtgt

SEQ ID NO: 67031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaatattgtttagaaaggt

SEQ ID NO: 67032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaatattgtttagaaagg

SEQ ID NO: 67033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcaatattgtttagaaag

SEQ ID NO: 67034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttctcaatattgtttag

SEQ ID NO: 67035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactaattttctcaatattg

SEQ ID NO: 67036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccactaattttctcaatatt

SEQ ID NO: 67037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggagtttccactaattttc

SEQ ID NO: 67038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggagtttccactaatttt

SEQ ID NO: 67039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttcaggagtttccactaa

SEQ ID NO: 67040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatttcaggagtttccacta

SEQ ID NO: 67041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacttaatttcaggagtttc

SEQ ID NO: 67042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaacttaatttcaggagttt

SEQ ID NO: 67043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaacttaatttcaggagtt

SEQ ID NO: 67044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaacttaatttcaggagt

SEQ ID NO: 67045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgaacttaatttcagga

SEQ ID NO: 67046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttgaacttaatttcagg

SEQ ID NO: 67047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcaagatgagtttcttttg

SEQ ID NO: 67048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatcaagatgagtttcttt

SEQ ID NO: 67049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaatcaagatgagtttctt

SEQ ID NO: 67050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatcttctaatcaagatgag

SEQ ID NO: 67051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctggatcttctaatcaag

SEQ ID NO: 67052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catctggatcttctaatcaa

SEQ ID NO: 67053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaacagtttcatctggatct

SEQ ID NO: 67054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaacagtttcatctggatc

SEQ ID NO: 67055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatacttgaaacagtttca

SEQ ID NO: 67056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaatacttgaaacagtttc

SEQ ID NO: 67057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttagaatacttgaaacag

SEQ ID NO: 67058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacttagaatacttgaaaca

SEQ ID NO: 67059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacttagaatacttgaaac

SEQ ID NO: 67060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaacttagaatacttgaaa

SEQ ID NO: 67061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttaacttagaatacttg

SEQ ID NO: 67062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttaacttagaatactt

SEQ ID NO: 67063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtcacatttgtttttaac

SEQ ID NO: 67064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtcacatttgtttttaa

SEQ ID NO: 67065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacataaaaatttaaagtca

SEQ ID NO: 67066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacataaaaatttaaagtc

SEQ ID NO: 67067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtacataaaaatttaaagt

SEQ ID NO: 67068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagcagtatattttgtacat

SEQ ID NO: 67069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagcagtatattttgtaca

SEQ ID NO: 67070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtagcagtatattttgtac

SEQ ID NO: 67071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtagcagtatattttgta

SEQ ID NO: 67072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtagcagtatattttgt

SEQ ID NO: 67073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttttgtagcagtatat

SEQ ID NO: 67074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattttttgtagcagtata

SEQ ID NO: 67075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaattttttgtagcagtat

SEQ ID NO: 67076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtacaattttcaatttttt

SEQ ID NO: 67077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtacaattttcaattttt

SEQ ID NO: 67078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtacaattttcaatttt

SEQ ID NO: 67079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagtacaattttcaattt

SEQ ID NO: 67080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
accatttttaagtacaattt

SEQ ID NO: 67081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaatgaataaacctaacc

SEQ ID NO: 67082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggacaaaagaatgcgtta

SEQ ID NO: 67083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatggacaaaagaatgcgtt

SEQ ID NO: 67084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggaaaggaaatcatgtaca

SEQ ID NO: 67085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgaggaaaggaaatcatg

SEQ ID NO: 67086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acataaattcactgaggaaa

SEQ ID NO: 67087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
accaaaacctaacataaatt

SEQ ID NO: 67088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctaaccaaaacctaacata

SEQ ID NO: 67089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctacctaaccaaaacctaa

SEQ ID NO: 67090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctacctaaccaaaaccta

SEQ ID NO: 67091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatctacctaaccaaaacct

SEQ ID NO: 67092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatctacctaaccaaaacc

SEQ ID NO: 67093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttatctacctaaccaaa

SEQ ID NO: 67094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttttatctacctaacca

SEQ ID NO: 67095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtttttatctacctaacc

SEQ ID NO: 67096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctgtttttatctaccta

SEQ ID NO: 67097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctgtttttatctacct

SEQ ID NO: 67098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtcatttatttctgtttt

SEQ ID NO: 67099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttatagtcatttatttctg

SEQ ID NO: 67100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatatctagttatagtcat

SEQ ID NO: 67101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttgccatatctagttatag

SEQ ID NO: 67102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttgccatatctagttata

SEQ ID NO: 67103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagttgccatatctagttat

SEQ ID NO: 67104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcactttagttgccatatct

SEQ ID NO: 67105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctgtcactttagttgccat

SEQ ID NO: 67106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actatctgtcactttagttg

SEQ ID NO: 67107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaaaatgaaccctgactat

SEQ ID NO: 67108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgctatcaaaatgaaccc

SEQ ID NO: 67109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatgctatcaaaatgaacc

SEQ ID NO: 67110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccatgctatcaaaatgaa

SEQ ID NO: 67111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttccatgctatcaaaatga

SEQ ID NO: 67112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttcttccatgctatcaaa

SEQ ID NO: 67113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagaaataagccaggtgaga

SEQ ID NO: 67114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaagaaataagccaggtga

SEQ ID NO: 67115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaagaaataagccaggtg

SEQ ID NO: 67116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcaagaaataagccaggt

SEQ ID NO: 67117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttctcaagaaataagccag

SEQ ID NO: 67118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctttctcaagaaataagcc

SEQ ID NO: 67119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atctctctttctcaagaaat

SEQ ID NO: 67120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgatctctctttctcaaga

SEQ ID NO: 67121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactgatctctctttctcaa

SEQ ID NO: 67122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggaagcctctactgatctct

SEQ ID NO: 67123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggaagcctctactgatct

SEQ ID NO: 67124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaggaagcctctactgatc

SEQ ID NO: 67125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctaggaagcctctactga

SEQ ID NO: 67126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catctcttctaggaagcctc

SEQ ID NO: 67127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacccaggctccatctcttc

SEQ ID NO: 67128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attcaacccaggctccatct

SEQ ID NO: 67129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattcaacccaggctccatc

SEQ ID NO: 67130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgattcaacccaggctccat

SEQ ID NO: 67131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atattttgattcaacccagg

SEQ ID NO: 67132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgatattttgattcaaccc

SEQ ID NO: 67133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgatattttgattcaacc

SEQ ID NO: 67134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgatattttgattcaac

SEQ ID NO: 67135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactgatattttgattcaa

SEQ ID NO: 67136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttactgatattttgattca

SEQ ID NO: 67137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttactgatattttgattc

SEQ ID NO: 67138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttttactgatattttgat

SEQ ID NO: 67139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacccaaactcttttttact

SEQ ID NO: 67140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaattccacccaaactcttt

SEQ ID NO: 67141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctggaattccacccaaact

SEQ ID NO: 67142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgcctggaattccacccaa

SEQ ID NO: 67143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgcctggaattccaccca

SEQ ID NO: 67144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctgcctggaattccaccc

SEQ ID NO: 67145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgctgcctggaattccacc

SEQ ID NO: 67146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcataacaatttttgctgc

SEQ ID NO: 67147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgcataacaatttttgct

SEQ ID NO: 67148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatgcataacaatttttgc

SEQ ID NO: 67149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttctatgcataacaatt

SEQ ID NO: 67150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatttctatgcataacaat

SEQ ID NO: 67151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtttaaatttctatgcataa

SEQ ID NO: 67152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactggtttaaatttctatg

SEQ ID NO: 67153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaactggtttaaatttcta

SEQ ID NO: 67154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catcacaattctaaactggt

SEQ ID NO: 67155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcatcacaattctaaactgg

SEQ ID NO: 67156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttgcatcacaattctaaac

SEQ ID NO: 67157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcttgcatcacaattctaa

SEQ ID NO: 67158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtacattctgcttgcatca

SEQ ID NO: 67159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgtacattctgcttgcatc

SEQ ID NO: 67160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtgtacattctgcttgca

SEQ ID NO: 67161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctcttgtgtacattctgct

SEQ ID NO: 67162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcctcttgtgtacattctgc

SEQ ID NO: 67163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acccttgcctcttgtgtaca

SEQ ID NO: 67164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcacccttgcctcttgtgta

SEQ ID NO: 67165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acctctcacccttgcctctt

SEQ ID NO: 67166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agctcacctctcacccttgc

SEQ ID NO: 67167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagctcacctctcaccctt

SEQ ID NO: 67168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaagctcacctctcaccct

SEQ ID NO: 67169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaagctcacctctcaccc

SEQ ID NO: 67170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctaagctcacctctcacc

SEQ ID NO: 67171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
accaatttttctaagctcac

SEQ ID NO: 67172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cataatctgaccaatttttc

SEQ ID NO: 67173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccataatctgaccaattttt

SEQ ID NO: 67174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccataatctgaccaatttt

SEQ ID NO: 67175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggtaaaggccaatgctttc

SEQ ID NO: 67176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaggtaaaggccaatgcttt

SEQ ID NO: 67177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttaaggtaaaggccaatgc

SEQ ID NO: 67178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aataggatataagccaaact

SEQ ID NO: 67179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacctcaataggatataagc

SEQ ID NO: 67180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcaacctcaataggatata

SEQ ID NO: 67181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcctcaacctcaataggat

SEQ ID NO: 67182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actcctcaacctcaatagga

SEQ ID NO: 67183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttactcctcaacctcaata

SEQ ID NO: 67184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttactcctcaacctcaat

SEQ ID NO: 67185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacttactcctcaacctcaa

SEQ ID NO: 67186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaccctttacttactcctc

SEQ ID NO: 67187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataaccctttacttactcct

SEQ ID NO: 67188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttataaccctttacttact

SEQ ID NO: 67189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgcttataaccctttact

SEQ ID NO: 67190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gttccctgcttataaccctt

SEQ ID NO: 67191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cgtatctcgttccctgctta

SEQ ID NO: 67192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcgtatctcgttccctgctt

SEQ ID NO: 67193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatttgcgtatctcgttcc

SEQ ID NO: 67194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattgcaatttgcgtatctc

SEQ ID NO: 67195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattgcaatttgcgtatct

SEQ ID NO: 67196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttacattgcaatttgcgta

SEQ ID NO: 67197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgtaccgtggagacatct

SEQ ID NO: 67198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctccatgtaccgtggaga

SEQ ID NO: 67199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcctccatgtaccgtggag

SEQ ID NO: 67200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caacttatcctccatgtacc

SEQ ID NO: 67201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaacttatcctccatgtac

SEQ ID NO: 67202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acccttccaacttatcctcc

SEQ ID NO: 67203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcacccttccaacttatcc

SEQ ID NO: 67204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattcacccttccaacttat

SEQ ID NO: 67205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctattcacccttccaactt

SEQ ID NO: 67206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctctattcacccttccaa

SEQ ID NO: 67207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcctctctattcacccttc

SEQ ID NO: 67208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acccctactcctctctattc

SEQ ID NO: 67209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacccctactcctctctatt

SEQ ID NO: 67210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcacccctactcctctcta

SEQ ID NO: 67211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcacccctactcctctct

SEQ ID NO: 67212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttcacccctactcctctc

SEQ ID NO: 67213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtatgaaactttcttcacc

SEQ ID NO: 67214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggtatgaaactttcttca

SEQ ID NO: 67215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgggtatgaaactttcttc

SEQ ID NO: 67216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgggtatgaaactttctt

SEQ ID NO: 67217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaccagaatccaaatggttt

SEQ ID NO: 67218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagacaggatactggaccag

SEQ ID NO: 67219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctccagacaggatactgga

SEQ ID NO: 67220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctccagacaggatactgg

SEQ ID NO: 67221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccctccagacaggatactg

SEQ ID NO: 67222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atctttccctccagacagga

SEQ ID NO: 67223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actaatctttccctccagac

SEQ ID NO: 67224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaactaatctttccctcca

SEQ ID NO: 67225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttcctaactaatctttccc

SEQ ID NO: 67226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagttcctaactaatctttc

SEQ ID NO: 67227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caactctagttcctaactaa

SEQ ID NO: 67228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttacaactctagttcctaac

SEQ ID NO: 67229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatctgttacaactctagtt

SEQ ID NO: 67230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatctgttacaactctagt

SEQ ID NO: 67231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaaatatgtcttgaatctg

SEQ ID NO: 67232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgccaaatatgtcttgaa

SEQ ID NO: 67233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctgccaaatatgtcttga

SEQ ID NO: 67234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatctgccaaatatgtcttg

SEQ ID NO: 67235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attttatctgccaaatatgt

SEQ ID NO: 67236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgattttatctgccaaata

SEQ ID NO: 67237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatccaatcaatcaccaaa

SEQ ID NO: 67238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatatccaatcaatcaccaa

SEQ ID NO: 67239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttgatatccaatcaatc

SEQ ID NO: 67240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatttgatatccaatcaat

SEQ ID NO: 67241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttacatttgatatccaatca

SEQ ID NO: 67242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttacatttgatatccaat

SEQ ID NO: 67243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttacatttgatatccaa

SEQ ID NO: 67244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcttacatttgatatcca

SEQ ID NO: 67245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttctcttacatttgatat

SEQ ID NO: 67246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctttctcttacatttgata

SEQ ID NO: 67247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggatccttcctttctcttac

SEQ ID NO: 67248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtagtcctgggatccttcct

SEQ ID NO: 67249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acatccacctggtagtcctg

SEQ ID NO: 67250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctaacatccacctggtagtc

SEQ ID NO: 67251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgctaacatccacctggt

SEQ ID NO: 67252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattcactgctaacatccac

SEQ ID NO: 67253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattcactgctaacatcca

SEQ ID NO: 67254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaattcactgctaacatcc

SEQ ID NO: 67255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggttttcaattcactgcta

SEQ ID NO: 67256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgtggttttcaattcactg

SEQ ID NO: 67257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcctgtggttttcaattca

SEQ ID NO: 67258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcctcctgtggttttcaat

SEQ ID NO: 67259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccgagtcagctcctcctcct

SEQ ID NO: 67260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgccgagtcagctcctcc

SEQ ID NO: 67261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaatcattacctgccgagt

SEQ ID NO: 67262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaggcatctcaaaatcatt

SEQ ID NO: 67263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacaattcacaggcatctca

SEQ ID NO: 67264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacaattcacaggcatctc

SEQ ID NO: 67265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatttaaacaattcacaggc

SEQ ID NO: 67266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggatatctgtatttaaac

SEQ ID NO: 67267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatctataggatatctgta

SEQ ID NO: 67268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatctataggatatctgt

SEQ ID NO: 67269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatctataggatatctg

SEQ ID NO: 67270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaatctataggatatct

SEQ ID NO: 67271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccacccccatttttaaaatc

SEQ ID NO: 67272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggttcccacccccattttt

SEQ ID NO: 67273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggttcccacccccatttt

SEQ ID NO: 67274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccgtttcaggttcccacccc

SEQ ID NO: 67275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccgtttcaggttcccaccc

SEQ ID NO: 67276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccgtttcaggttcccacc

SEQ ID NO: 67277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcccgtttcaggttcccac

SEQ ID NO: 67278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gacaggtttttcccgtttca

SEQ ID NO: 67279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagacaggtttttcccgttt

SEQ ID NO: 67280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagacaggtttttcccgtt

SEQ ID NO: 67281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctagacaggtttttcccgt

SEQ ID NO: 67282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctagacaggtttttcccg

SEQ ID NO: 67283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttctagacaggtttttcc

SEQ ID NO: 67284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaattcttttctagacagg

SEQ ID NO: 67285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaagaattcttttctagac

SEQ ID NO: 67286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactaagaattcttttcta

SEQ ID NO: 67287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attattactaagaattcttt

SEQ ID NO: 67288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcagatacatgtatgctaa

SEQ ID NO: 67289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagcagatacatgtatgcta

SEQ ID NO: 67290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acttcagcagatacatgtat

SEQ ID NO: 67291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgacttcagcagatacatgt

SEQ ID NO: 67292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctgacttcagcagataca

SEQ ID NO: 67293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaactgttctgacttcag

SEQ ID NO: 67294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgacctcaaaaactgttc

SEQ ID NO: 67295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtgacctcaaaaactgtt

SEQ ID NO: 67296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtgacctcaaaaactgt

SEQ ID NO: 67297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgtgacctcaaaaactg

SEQ ID NO: 67298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgtgtgacctcaaaaact

SEQ ID NO: 67299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttttgtgtgacctcaaaaa

SEQ ID NO: 67300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatactctttttgtgtgacc

SEQ ID NO: 67301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accctaaatactctttttgt

SEQ ID NO: 67302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcaccctaaatactctttt

SEQ ID NO: 67303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgctcaccctaaatactctt

SEQ ID NO: 67304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgctcaccctaaatactct

SEQ ID NO: 67305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgctcaccctaaatactc

SEQ ID NO: 67306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgctcaccctaaatact

SEQ ID NO: 67307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctgctcaccctaaatac

SEQ ID NO: 67308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccctttttctgctcaccct

SEQ ID NO: 67309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggagttggccctttttctgc

SEQ ID NO: 67310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cggagttggccctttttctg

SEQ ID NO: 67311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaatgtttcggagttggcc

SEQ ID NO: 67312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaatgtttcggagttggc

SEQ ID NO: 67313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcagaatgtttcggagtt

SEQ ID NO: 67314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtttcagaatgtttcgga

SEQ ID NO: 67315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atattgttgtttcagaatgt

SEQ ID NO: 67316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatattgttgtttcagaatg

SEQ ID NO: 67317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccttaatattgttgtttcag

SEQ ID NO: 67318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcccttaatattgttgtttc

SEQ ID NO: 67319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcccttaatattgttgtt

SEQ ID NO: 67320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattctctcccttaatattg

SEQ ID NO: 67321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcacaccattgaattctct

SEQ ID NO: 67322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcacaccattgaattctc

SEQ ID NO: 67323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagcacaccattgaattct

SEQ ID NO: 67324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttcagcacaccattgaat

SEQ ID NO: 67325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtatggtctgctttcagcac

SEQ ID NO: 67326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaacaagaattggtatggt

SEQ ID NO: 67327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaacaagaattggtatgg

SEQ ID NO: 67328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acagtttaacaacaagaatt

SEQ ID NO: 67329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgacagtttaacaacaagaa

SEQ ID NO: 67330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgacagtttaacaacaaga

SEQ ID NO: 67331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaacagacaagcaggaatt

SEQ ID NO: 67332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaacagacaagcaggaat

SEQ ID NO: 67333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacaacagacaagcaggaa

SEQ ID NO: 67334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaacaacagacaagcagga

SEQ ID NO: 67335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttttaacaacagacaagca

SEQ ID NO: 67336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatggctgcttttaacaa

SEQ ID NO: 67337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataatggctgcttttaaca

SEQ ID NO: 67338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatagtcaaatatttaataa

SEQ ID NO: 67339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatagtcaaatatttaata

SEQ ID NO: 67340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtttatatagtcaaatatt

SEQ ID NO: 67341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagtttatatagtcaaata

SEQ ID NO: 67342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagaattctaagtttatata

SEQ ID NO: 67343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggtaagttatagaattcta

SEQ ID NO: 67344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaggtaagttatagaattct

SEQ ID NO: 67345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttaaggtaagttatagaat

SEQ ID NO: 67346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttaaggtaagttatagaa

SEQ ID NO: 67347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccttaaggtaagttataga

SEQ ID NO: 67348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctttccttaaggtaagtta

SEQ ID NO: 67349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacctttccttaaggtaag

SEQ ID NO: 67350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attacctttccttaaggtaa

SEQ ID NO: 67351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatttattacctttcctta

SEQ ID NO: 67352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtatttattacctttcctt

SEQ ID NO: 67353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaagtgatatgtcttagta

SEQ ID NO: 67354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaacggaatagacaaataaa

SEQ ID NO: 67355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcaaacggaatagacaaat

SEQ ID NO: 67356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctattcaaacggaatagaca

SEQ ID NO: 67357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgctattcaaacggaataga

SEQ ID NO: 67358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgctattcaaacggaatag

SEQ ID NO: 67359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tccagagagaataatccaga

SEQ ID NO: 67360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgtccagagagaataatcc

SEQ ID NO: 67361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctactgtccagagagaataa

SEQ ID NO: 67362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacagtagcccaatagtata

SEQ ID NO: 67363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caccatccagatagaatagg

SEQ ID NO: 67364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaccatccagatagaatag

SEQ ID NO: 67365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacagtgtgacatacttcca

SEQ ID NO: 67366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagtagctcaacagtgtga

SEQ ID NO: 67367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaagagattcacagtagct

SEQ ID NO: 67368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgcagagttaagaagaga

SEQ ID NO: 67369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaatgcagagttaagaag

SEQ ID NO: 67370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgtgaaattgctaaatgca

SEQ ID NO: 67371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgatgtgaaattgctaaat

SEQ ID NO: 67372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaactactgatgtgaaattg

SEQ ID NO: 67373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaactactgatgtgaaatt

SEQ ID NO: 67374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttcaaactactgatgtga

SEQ ID NO: 67375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaccatcactgatttcaaa

SEQ ID NO: 67376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatgtaaagattcccacca

SEQ ID NO: 67377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaatgtaaagattcccacc

SEQ ID NO: 67378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaatgtaaagattcccac

SEQ ID NO: 67379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtaatgtaaagattccca

SEQ ID NO: 67380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagatttttgtaatgtaaag

SEQ ID NO: 67381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggagatttttgtaatgtaaa

SEQ ID NO: 67382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtgcttggagatttttgt

SEQ ID NO: 67383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagtgcttggagatttttg

SEQ ID NO: 67384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttgtagtgcttggagatt

SEQ ID NO: 67385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatttgtagtgcttggaga

SEQ ID NO: 67386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaaatcaagaagctctcat

SEQ ID NO: 67387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagaaaatcaagaagctctc

SEQ ID NO: 67388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctctagaaaatcaagaagct

SEQ ID NO: 67389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactctagaaaatcaagaag

SEQ ID NO: 67390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attctactctagaaaatcaa

SEQ ID NO: 67391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattctactctagaaaatca

SEQ ID NO: 67392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaattctactctagaaaat

SEQ ID NO: 67393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttaattctactctagaaaa

SEQ ID NO: 67394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catcaccttcttaattctac

SEQ ID NO: 67395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctccatcaccttcttaattc

SEQ ID NO: 67396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctccatcaccttcttaatt

SEQ ID NO: 67397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcatttcctccatcaccttc

SEQ ID NO: 67398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggcatttcctccatcacc

SEQ ID NO: 67399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attggcatttcctccatcac

SEQ ID NO: 67400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattggcatttcctccatca

SEQ ID NO: 67401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttattggcatttcctcca

SEQ ID NO: 67402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgttttattggcatttcc

SEQ ID NO: 67403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctgttttattggcatttc

SEQ ID NO: 67404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttatctgttttattggcat

SEQ ID NO: 67405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actgtttatctgttttattg

SEQ ID NO: 67406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gactgtttatctgttttatt

SEQ ID NO: 67407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaacacaatacaccttgac

SEQ ID NO: 67408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagtaatggctacaaacac

SEQ ID NO: 67409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcagagtaatggctacaaa

SEQ ID NO: 67410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgctattcagagtaatggct

SEQ ID NO: 67411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgctattcagagtaatggc

SEQ ID NO: 67412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgctattcagagtaatgg

SEQ ID NO: 67413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgctattcagagtaatg

SEQ ID NO: 67414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttgtgctattcagagt

SEQ ID NO: 67415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttttgtgctattcagag

SEQ ID NO: 67416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatttttgtgctattcaga

SEQ ID NO: 67417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatttttgtgctattcag

SEQ ID NO: 67418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaatttttgtgctattca

SEQ ID NO: 67419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aataatgaaaggatattttt

SEQ ID NO: 67420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caataatgaaaggatatttt

SEQ ID NO: 67421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaatcaaaaaacagaattt

SEQ ID NO: 67422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaaatcaaaaaacagaatt

SEQ ID NO: 67423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgcaaatcaaaaaacaga

SEQ ID NO: 67424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcagtgatgtaagcaatta

SEQ ID NO: 67425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attcatcagtgatgtaagca

SEQ ID NO: 67426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcattcatcagtgatgtaa

SEQ ID NO: 67427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcattcatcagtgatgta

SEQ ID NO: 67428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactcattcatcagtgatgt

SEQ ID NO: 67429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgtcagaactttactcat

SEQ ID NO: 67430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcagtgaaataaaaaagaa

SEQ ID NO: 67431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttagtcagtgaaataaaa

SEQ ID NO: 67432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgttagtcagtgaaataaa

SEQ ID NO: 67433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatttatgttagtcagtga

SEQ ID NO: 67434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatatttatgttagtcagtg

SEQ ID NO: 67435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttgatatttatgttagtca

SEQ ID NO: 67436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatgaagactgcttgatat

SEQ ID NO: 67437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcatgaagactgcttgata

SEQ ID NO: 67438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagcatgaagactgcttgat

SEQ ID NO: 67439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataaacaagtatagttttag

SEQ ID NO: 67440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagctaataaacaagtatag

SEQ ID NO: 67441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagctaataaacaagtata

SEQ ID NO: 67442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcagctaataaacaagtat

SEQ ID NO: 67443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcagctaataaacaagta

SEQ ID NO: 67444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttttgcagctaataaacaa

SEQ ID NO: 67445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgtataggcaacctattt

SEQ ID NO: 67446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatgtataggcaacctatt

SEQ ID NO: 67447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcatgtataggcaacctat

SEQ ID NO: 67448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgcatgtataggcaaccta

SEQ ID NO: 67449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaaacttttgcatgtatag

SEQ ID NO: 67450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccaaacttttgcatgtata

SEQ ID NO: 67451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgccaaacttttgcatgtat

SEQ ID NO: 67452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactttgccaaacttttgca

SEQ ID NO: 67453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaactttgccaaacttttgc

SEQ ID NO: 67454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaactttgccaaacttttg

SEQ ID NO: 67455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaactttgccaaactttt

SEQ ID NO: 67456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgaactttgccaaacttt

SEQ ID NO: 67457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgaactttgccaaactt

SEQ ID NO: 67458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttgaactttgccaaact

SEQ ID NO: 67459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagaatgctttttttgaac

SEQ ID NO: 67460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaagaatgctttttttga

SEQ ID NO: 67461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaaagaatgctttttttg

SEQ ID NO: 67462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttctcaaagaatgcttttt

SEQ ID NO: 67463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatatcaaattgtttctcaa

SEQ ID NO: 67464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtatatcaaattgtttctc

SEQ ID NO: 67465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacattctgtatatcaaatt

SEQ ID NO: 67466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaacattctgtatatcaa

SEQ ID NO: 67467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgaacattctgtatatca

SEQ ID NO: 67468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgaacattctgtatatc

SEQ ID NO: 67469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattgaacattctgtatat

SEQ ID NO: 67470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttattgaacattctgtata

SEQ ID NO: 67471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caactttttattgaacattc

SEQ ID NO: 67472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaataataaaatattacaa

SEQ ID NO: 67473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaataataaaatattaca

SEQ ID NO: 67474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggatatatgacacacaattt

SEQ ID NO: 67475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atattaggatatatgacaca

SEQ ID NO: 67476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgatattaggatatatgac

SEQ ID NO: 67477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgatattaggatatatga

SEQ ID NO: 67478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgatattaggatatatg

SEQ ID NO: 67479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaattttactgatattagg

SEQ ID NO: 67480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctataaattttactgatatt

SEQ ID NO: 67481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actataaattttactgatat

SEQ ID NO: 67482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcatttactataaatttt

SEQ ID NO: 67483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatcatttactataaattt

SEQ ID NO: 67484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaggaaaataaaaaatgtg

SEQ ID NO: 67485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccaaggaaaataaaaaatg

SEQ ID NO: 67486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttctccaaggaaaataaaa

SEQ ID NO: 67487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaactggttctccaaggaa

SEQ ID NO: 67488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaactggttctccaagga

SEQ ID NO: 67489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataaactggttctccaagg

SEQ ID NO: 67490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttataaactggttctccaag

SEQ ID NO: 67491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgatgtgtaggtaaatatt

SEQ ID NO: 67492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcctagtgatgtgtaggtaa

SEQ ID NO: 67493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctgtcctagtgatgtgtag

SEQ ID NO: 67494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacctgtcctagtgatgtgt

SEQ ID NO: 67495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctacctgtcctagtgatg

SEQ ID NO: 67496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctctacctgtcctagtga

SEQ ID NO: 67497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcctctacctgtcctagtg

SEQ ID NO: 67498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcctctacctgtcctagt

SEQ ID NO: 67499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagttttctcctctacctg

SEQ ID NO: 67500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaagttttctcctctacct

SEQ ID NO: 67501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttcaaagttttctcctcta

SEQ ID NO: 67502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctacttcaaagttttctc

SEQ ID NO: 67503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catctacttcaaagttttct

SEQ ID NO: 67504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttcatctacttcaaagtt

SEQ ID NO: 67505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatttcatctacttcaaag

SEQ ID NO: 67506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctctcatttcatctactt

SEQ ID NO: 67507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcatctctcatttcatcta

SEQ ID NO: 67508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttcatctctcatttcatct

SEQ ID NO: 67509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgttcatctctcatttcat

SEQ ID NO: 67510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgttcatctctcatttca

SEQ ID NO: 67511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtccttcttgttcatctctc

SEQ ID NO: 67512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtccttcttgttcatctct

SEQ ID NO: 67513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttggtccttcttgttcatct

SEQ ID NO: 67514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caccctcttggtccttcttg

SEQ ID NO: 67515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgcaccctcttggtccttc

SEQ ID NO: 67516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgcaccctcttggtcctt

SEQ ID NO: 67517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgcaccctcttggtcct

SEQ ID NO: 67518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttactgcaccctcttggtcc

SEQ ID NO: 67519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttactgcaccctcttggt

SEQ ID NO: 67520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttttactgcaccctcttg

SEQ ID NO: 67521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttttactgcaccctctt

SEQ ID NO: 67522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttctcttttactgcaccc

SEQ ID NO: 67523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtttctcttttactgcacc

SEQ ID NO: 67524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtttctcttttactgcac

SEQ ID NO: 67525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttggtttctcttttactgc

SEQ ID NO: 67526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctttggtttctcttttac

SEQ ID NO: 67527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actctttggtttctctttta

SEQ ID NO: 67528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactctttggtttctctttt

SEQ ID NO: 67529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactctttggtttctcttt

SEQ ID NO: 67530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttactctttggtttctctt

SEQ ID NO: 67531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaactttttactctttgg

SEQ ID NO: 67532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataaaactttttactctttg

SEQ ID NO: 67533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttataaaactttttactctt

SEQ ID NO: 67534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttataaaactttttactct

SEQ ID NO: 67535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcacttcttataaaactttt

SEQ ID NO: 67536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcacttcttataaaacttt

SEQ ID NO: 67537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttatcacttcttataaaac

SEQ ID NO: 67538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtttatcacttcttataaa

SEQ ID NO: 67539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagctctgtttatcacttc

SEQ ID NO: 67540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttcatagctctgtttatc

SEQ ID NO: 67541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgttcatagctctgtttat

SEQ ID NO: 67542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttatgttcatagctctgttt

SEQ ID NO: 67543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcctcttatgttcatagct

SEQ ID NO: 67544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggcctcttatgttcatag

SEQ ID NO: 67545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgggcctcttatgttcata

SEQ ID NO: 67546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgggcctcttatgttcat

SEQ ID NO: 67547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttctgggcctcttatgttc

SEQ ID NO: 67548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttctgggcctcttatgt

SEQ ID NO: 67549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatcattctctttctgggcc

SEQ ID NO: 67550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatcattctctttctgggc

SEQ ID NO: 67551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgtttcaatcattctctt

SEQ ID NO: 67552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatgtttcaatcattctct

SEQ ID NO: 67553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaatgtttcaatcattctc

SEQ ID NO: 67554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaatgtttcaatcattct

SEQ ID NO: 67555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatttttcaatgtttcaat

SEQ ID NO: 67556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attaaaatttttcaatgttt

SEQ ID NO: 67557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgattaaaatttttcaa

SEQ ID NO: 67558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattgattaaaatttttca

SEQ ID NO: 67559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaattgattaaaatttttc

SEQ ID NO: 67560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaactttaaattgattaa

SEQ ID NO: 67561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataaactttaaattgatta

SEQ ID NO: 67562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taataaactttaaattgatt

SEQ ID NO: 67563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttaataaactttaaattg

SEQ ID NO: 67564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttgctttaataaactttaa

SEQ ID NO: 67565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagttgctttaataaacttt

SEQ ID NO: 67566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagtaattctagttgcttt

SEQ ID NO: 67567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagagtaattctagttgctt

SEQ ID NO: 67568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcagagtaattctagttgc

SEQ ID NO: 67569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcagagtaattctagttg

SEQ ID NO: 67570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttcagagtaattctagtt

SEQ ID NO: 67571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttcagagtaattctagt

SEQ ID NO: 67572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttcttcagagtaattcta

SEQ ID NO: 67573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttttcttcagagtaattc

SEQ ID NO: 67574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagagtctctcttttcttca

SEQ ID NO: 67575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagagtctctcttttcttc

SEQ ID NO: 67576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagagtctctcttttctt

SEQ ID NO: 67577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaagagtctctcttttct

SEQ ID NO: 67578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaaagagtctctcttttc

SEQ ID NO: 67579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttttaaagagtctctctt

SEQ ID NO: 67580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagttactttttaaagagtc

SEQ ID NO: 67581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgtagttactttttaaag

SEQ ID NO: 67582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaggaagaattcactgtag

SEQ ID NO: 67583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaggaagaattcactgta

SEQ ID NO: 67584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgaggaagaattcactgt

SEQ ID NO: 67585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaattttatgaggaagaatt

SEQ ID NO: 67586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctaaaattttatgaggaa

SEQ ID NO: 67587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catctaaaattttatgagga

SEQ ID NO: 67588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatctaaaattttatgagg

SEQ ID NO: 67589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatctaaaattttatgag

SEQ ID NO: 67590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatgaggtttttcatctaa

SEQ ID NO: 67591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctaaaatgaggtttttca

SEQ ID NO: 67592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catctaaaatgaggtttttc

SEQ ID NO: 67593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccttcatctaaaatgaggtt

SEQ ID NO: 67594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgccttcatctaaaatgag

SEQ ID NO: 67595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccacctcctgccttcatcta

SEQ ID NO: 67596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccacctcctgccttcatct

SEQ ID NO: 67597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcccacctcctgccttcatc

SEQ ID NO: 67598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttcccacctcctgccttc

SEQ ID NO: 67599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actttcccacctcctgcctt

SEQ ID NO: 67600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttactttcccacctcctgcc

SEQ ID NO: 67601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccattcttactttcccacc

SEQ ID NO: 67602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaacaggtatcaaaaaagtg

SEQ ID NO: 67603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaacaggtatcaaaaaag

SEQ ID NO: 67604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgaaacaggtatcaaaaaa

SEQ ID NO: 67605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaacttctgaaacaggtatc

SEQ ID NO: 67606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaattcaaacttctgaaaca

SEQ ID NO: 67607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaatatctaaaattcaaac

SEQ ID NO: 67608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaatatctaaaattcaaa

SEQ ID NO: 67609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaaatatctaaaattcaa

SEQ ID NO: 67610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagaaatatctaaaattca

SEQ ID NO: 67611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagaaaaggagatcaatctt

SEQ ID NO: 67612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagaaaaggagatcaatct

SEQ ID NO: 67613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacagaaaaggagatcaatc

SEQ ID NO: 67614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttacagaaaaggagatca

SEQ ID NO: 67615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattgttttacagaaaagga

SEQ ID NO: 67616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaattatattgttttaca

SEQ ID NO: 67617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaatgaattatattgtttt

SEQ ID NO: 67618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttaatgaattatattgttt

SEQ ID NO: 67619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatacttgttaatgaattat

SEQ ID NO: 67620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaactcaatacttgttaat

SEQ ID NO: 67621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaaactcaatacttgttaa

SEQ ID NO: 67622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgaaaactcaatacttgt

SEQ ID NO: 67623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttacttgaaaactcaatact

SEQ ID NO: 67624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagttgttacttgaaaactc

SEQ ID NO: 67625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgaagttgttacttgaaa

SEQ ID NO: 67626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgattatctgaagttgttac

SEQ ID NO: 67627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgattatctgaagttgtta

SEQ ID NO: 67628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaacatacaacttatgatta

SEQ ID NO: 67629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaacatacaacttatgatt

SEQ ID NO: 67630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaacatacaacttatgat

SEQ ID NO: 67631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttagaacatacaacttat

SEQ ID NO: 67632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgttttagaacatacaact

SEQ ID NO: 67633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgttttagaacatacaac

SEQ ID NO: 67634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgttttagaacatacaa

SEQ ID NO: 67635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttttgttgttttagaacat

SEQ ID NO: 67636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagttttgttgttttagaac

SEQ ID NO: 67637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaagaggattctagttttg

SEQ ID NO: 67638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcaagaggattctagtttt

SEQ ID NO: 67639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaggtgcatcttgtcaaga

SEQ ID NO: 67640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taccaggtgcatcttgtcaa

SEQ ID NO: 67641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaccaggtgcatcttgtca

SEQ ID NO: 67642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaccaggtgcatcttgtc

SEQ ID NO: 67643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaacattttctaccaggt

SEQ ID NO: 67644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attacaaaacattttctacc

SEQ ID NO: 67645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaacatgaaaagattcat

SEQ ID NO: 67646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagaaacatgaaaagattca

SEQ ID NO: 67647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacttcagaaacatgaaaag

SEQ ID NO: 67648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attagacttcagaaacatga

SEQ ID NO: 67649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatcaatgcactaattagac

SEQ ID NO: 67650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcaactggatcaatgcac

SEQ ID NO: 67651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatcaactggatcaatgca

SEQ ID NO: 67652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaaataaccttatatcaac

SEQ ID NO: 67653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtgctagaaaataacctt

SEQ ID NO: 67654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaattaaagtgctagaaaa

SEQ ID NO: 67655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagagctggaaattaaagtg

SEQ ID NO: 67656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatagagctggaaattaaag

SEQ ID NO: 67657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatagagctggaaattaaa

SEQ ID NO: 67658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatttctatagagctggaaa

SEQ ID NO: 67659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtatttctatagagctgg

SEQ ID NO: 67660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgtatttctatagagctg

SEQ ID NO: 67661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgctgtatttctatagag

SEQ ID NO: 67662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttgctgtatttctataga

SEQ ID NO: 67663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagagagaaaaaacaggaac

SEQ ID NO: 67664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccagagagaaaaaacaggaa

SEQ ID NO: 67665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaacttccagagagaaaaa

SEQ ID NO: 67666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaaacttccagagagaaaa

SEQ ID NO: 67667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaacttagaaacttccaga

SEQ ID NO: 67668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggaacttagaaacttcca

SEQ ID NO: 67669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgggaacttagaaacttcc

SEQ ID NO: 67670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtcttctgggaacttagaa

SEQ ID NO: 67671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtcttctgggaacttaga

SEQ ID NO: 67672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtttgagtcttctgggaac

SEQ ID NO: 67673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagactcagtttgagtcttc

SEQ ID NO: 67674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taagcacaaagagcaagcat

SEQ ID NO: 67675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatgagtactataagcaca

SEQ ID NO: 67676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agccaagtagaggactatga

SEQ ID NO: 67677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaagccaagtagaggacta

SEQ ID NO: 67678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaatgacctattaagccaa

SEQ ID NO: 67679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatcaactataaatgacc

SEQ ID NO: 67680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaatcaactataaatgac

SEQ ID NO: 67681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaatcaactataaatga

SEQ ID NO: 67682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaaatcaactataaatg

SEQ ID NO: 67683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggaatcaagtcttttaaaa

SEQ ID NO: 67684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggggaatcaagtcttttaaa

SEQ ID NO: 67685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggggaatcaagtcttttaa

SEQ ID NO: 67686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggggaatcaagtctttta

SEQ ID NO: 67687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttggggaatcaagtctttt

SEQ ID NO: 67688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttttggggaatcaagtctt

SEQ ID NO: 67689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataactctttttggggaat

SEQ ID NO: 67690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagattatataactctttt

SEQ ID NO: 67691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaagattatataactcttt

SEQ ID NO: 67692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttagaagattatataactc

SEQ ID NO: 67693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actgcttagaagattatata

SEQ ID NO: 67694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgactaactgcttagaagat

SEQ ID NO: 67695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaattatgactaactgctta

SEQ ID NO: 67696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaattatgactaactgctt

SEQ ID NO: 67697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaattatgactaactgct

SEQ ID NO: 67698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagagatgtaacctttcaa

SEQ ID NO: 67699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtaaagtatagaattcaca

SEQ ID NO: 67700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtaaagtatagaattcac

SEQ ID NO: 67701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atccaatgtttatgtaaagt

SEQ ID NO: 67702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catccaatgtttatgtaaag

SEQ ID NO: 67703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatccaatgtttatgtaaa

SEQ ID NO: 67704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatccaatgtttatgtaa

SEQ ID NO: 67705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcatccaatgtttatgta

SEQ ID NO: 67706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttcatccaatgtttatg

SEQ ID NO: 67707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttcatccaatgtttat

SEQ ID NO: 67708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttttcatccaatgttta

SEQ ID NO: 67709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttttcatccaatgttt

SEQ ID NO: 67710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctttttcatccaatgtt

SEQ ID NO: 67711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctttttcatccaatgt

SEQ ID NO: 67712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttctttttcatccaatg

SEQ ID NO: 67713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttctttttcatccaat

SEQ ID NO: 67714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttttctttttcatccaa

SEQ ID NO: 67715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctttttttttctttttca

SEQ ID NO: 67716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattcacctttttttttctt

SEQ ID NO: 67717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccattcacctttttttttct

SEQ ID NO: 67718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccattcacctttttttttc

SEQ ID NO: 67719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgtagattttccattcac

SEQ ID NO: 67720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataaatgaagctatgtgta

SEQ ID NO: 67721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acattgtataaatgaagcta

SEQ ID NO: 67722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taattaacattgtataaatg

SEQ ID NO: 67723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgtaattaacattgtata

SEQ ID NO: 67724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatcatgttcactgtaatt

SEQ ID NO: 67725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatctgagatcatgttcac

SEQ ID NO: 67726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagatctgagatcatgttca

SEQ ID NO: 67727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtataggatgatacataat

SEQ ID NO: 67728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtataggatgatacataa

SEQ ID NO: 67729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaagtataggatgataca

SEQ ID NO: 67730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgcatgtagataataatt

SEQ ID NO: 67731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actaaatgcatgtagataat

SEQ ID NO: 67732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aactaaatgcatgtagataa

SEQ ID NO: 67733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaactaaatgcatgtagat

SEQ ID NO: 67734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttaactaaatgcatgtag

SEQ ID NO: 67735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcttaactaaatgcatgt

SEQ ID NO: 67736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcgaatgttctctcttaact

SEQ ID NO: 67737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcgaatgttctctcttaac

SEQ ID NO: 67738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcgaatgttctctcttaa

SEQ ID NO: 67739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcattttatcgaatgttc

SEQ ID NO: 67740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatcattttatcgaatgtt

SEQ ID NO: 67741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatcattttatcgaatgt

SEQ ID NO: 67742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatatcattttatcgaatg

SEQ ID NO: 67743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttatatcattttatcga

SEQ ID NO: 67744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtttttatatcattttatc

SEQ ID NO: 67745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctgtttttatatcatttt

SEQ ID NO: 67746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actctgtttttatatcattt

SEQ ID NO: 67747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactctgtttttatatcatt

SEQ ID NO: 67748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttactctgtttttatatcat

SEQ ID NO: 67749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccttttactctgtttttat

SEQ ID NO: 67750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accctacccttttactctgt

SEQ ID NO: 67751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaccctacccttttactctg

SEQ ID NO: 67752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaccctacccttttactct

SEQ ID NO: 67753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaccctacccttttactc

SEQ ID NO: 67754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttgaccctaccctttt

SEQ ID NO: 67755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagttaatttttgaccctac

SEQ ID NO: 67756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agagttaatttttgacccta

SEQ ID NO: 67757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttagagttaatttttgac

SEQ ID NO: 67758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaaagattaacttagagtt

SEQ ID NO: 67759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgaaaaagattaacttag

SEQ ID NO: 67760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctgaaaaagattaactta

SEQ ID NO: 67761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccctgaaaaagattaactt

SEQ ID NO: 67762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttccctgaaaaagattaa

SEQ ID NO: 67763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttccctgaaaaagatta

SEQ ID NO: 67764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttccctgaaaaagatt

SEQ ID NO: 67765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttccctgaaaaagat

SEQ ID NO: 67766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtatttttattttccctgaa

SEQ ID NO: 67767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggtatttttattttccctg

SEQ ID NO: 67768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctggtatttttattttccc

SEQ ID NO: 67769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctggtatttttattttc

SEQ ID NO: 67770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gctctctctggtatttttat

SEQ ID NO: 67771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgctctctctggtattttta

SEQ ID NO: 67772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgctctctctggtattttt

SEQ ID NO: 67773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcgctctctctggtatttt

SEQ ID NO: 67774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcgctctctctggtattt

SEQ ID NO: 67775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcgctctctctggtatt

SEQ ID NO: 67776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttttttcgctctctctgg

SEQ ID NO: 67777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctcatttttttcgctctc

SEQ ID NO: 67778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaattcatctcatttttt

SEQ ID NO: 67779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atattaaaaaattcatctca

SEQ ID NO: 67780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agttaatattaaaaaattca

SEQ ID NO: 67781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagcactaagttaatattaa

SEQ ID NO: 67782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaagcactaagttaatatt

SEQ ID NO: 67783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agacaaattctaaagcacta

SEQ ID NO: 67784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagacaaattctaaagcact

SEQ ID NO: 67785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtttaagacaaattctaaa

SEQ ID NO: 67786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtttaagacaaattctaa

SEQ ID NO: 67787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtttaagacaaattcta

SEQ ID NO: 67788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagtttaagacaaattct

SEQ ID NO: 67789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttaagtttaagacaaat

SEQ ID NO: 67790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgtgatcattgtttttaa

SEQ ID NO: 67791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatgtgatcattgttttta

SEQ ID NO: 67792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatatgtgatcattgtttt

SEQ ID NO: 67793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttatatgtgatcattgttt

SEQ ID NO: 67794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttatatgtgatcattgtt

SEQ ID NO: 67795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcttatatgtgatcattg

SEQ ID NO: 67796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaaagataaattctttctt

SEQ ID NO: 67797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccctgagaaagataaattc

SEQ ID NO: 67798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcccctgagaaagataaatt

SEQ ID NO: 67799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccaataatttgcccctgag

SEQ ID NO: 67800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atccaataatttgcccctga

SEQ ID NO: 67801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatccaataatttgcccct

SEQ ID NO: 67802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttatccaataatttgcccc

SEQ ID NO: 67803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttatccaataatttgccc

SEQ ID NO: 67804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accaaagggataattttctt

SEQ ID NO: 67805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaccaaagggataattttct

SEQ ID NO: 67806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaccaaagggataatttt

SEQ ID NO: 67807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttaaccaaagggataattt

SEQ ID NO: 67808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaaaagtaaatcccagaga

SEQ ID NO: 67809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agattgacaaaagtaaatcc

SEQ ID NO: 67810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagattgacaaaagtaaatc

SEQ ID NO: 67811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagattgacaaaagtaaat

SEQ ID NO: 67812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttaagattgacaaaag

SEQ ID NO: 67813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caattttaagattgacaaaa

SEQ ID NO: 67814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttcaattttaagattgac

SEQ ID NO: 67815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccttcaattttaagattga

SEQ ID NO: 67816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatcataagaataatgtttc

SEQ ID NO: 67817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcaatcataagaataatgt

SEQ ID NO: 67818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcaatcataagaataatg

SEQ ID NO: 67819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcctcaatcataagaata

SEQ ID NO: 67820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcctcaatcataagaat

SEQ ID NO: 67821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttcctcaatcataagaa

SEQ ID NO: 67822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttcctcaatcataaga

SEQ ID NO: 67823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtttttatttcctcaatc

SEQ ID NO: 67824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgtttttatttcctcaat

SEQ ID NO: 67825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgtttttatttcctcaa

SEQ ID NO: 67826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtgtttttatttcctca

SEQ ID NO: 67827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggatttttagtgtttttatt

SEQ ID NO: 67828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attaggatttttagtgtttt

SEQ ID NO: 67829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taattaggatttttagtgtt

SEQ ID NO: 67830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaattaggatttttagtgt

SEQ ID NO: 67831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaattaggatttttagtg

SEQ ID NO: 67832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctaattaggatttttagt

SEQ ID NO: 67833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acttttctaattaggatttt

SEQ ID NO: 67834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaacttttctaattaggat

SEQ ID NO: 67835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actaacttttctaattagga

SEQ ID NO: 67836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagtttactaacttttcta

SEQ ID NO: 67837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agattgaaagtttactaact

SEQ ID NO: 67838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagattgaaagtttactaac

SEQ ID NO: 67839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttcagattgaaagtttac

SEQ ID NO: 67840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catttcagattgaaagttta

SEQ ID NO: 67841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaaacttcatttcagattg

SEQ ID NO: 67842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaaacttcatttcagatt

SEQ ID NO: 67843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agggcaatatttatgaaact

SEQ ID NO: 67844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtgtaataaaccctgagg

SEQ ID NO: 67845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaggtgtaataaaccctga

SEQ ID NO: 67846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgaggtgtaataaaccct

SEQ ID NO: 67847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaataagagaaagaaactc

SEQ ID NO: 67848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctcaaaataagagaaagaa

SEQ ID NO: 67849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcctcaaaataagagaaaga

SEQ ID NO: 67850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgcctcaaaataagagaaa

SEQ ID NO: 67851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catcactcttgcctcaaaat

SEQ ID NO: 67852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacaaaaaccagacaggcgc

SEQ ID NO: 67853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacaaaaaccagacaggcg

SEQ ID NO: 67854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcacaaaaaccagacaggc

SEQ ID NO: 67855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggatatacctttgcacaaaa

SEQ ID NO: 67856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggatatacctttgcacaaa

SEQ ID NO: 67857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgggatatacctttgcaca

SEQ ID NO: 67858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaatctcttgggatatacc

SEQ ID NO: 67859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttggaaatctcttgggata

SEQ ID NO: 67860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agttggaaatctcttgggat

SEQ ID NO: 67861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
accagcttagttggaaatct

SEQ ID NO: 67862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaccagcttagttggaaa

SEQ ID NO: 67863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagagaaggtatgataacat

SEQ ID NO: 67864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagagaaggtatgataaca

SEQ ID NO: 67865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagagaaggtatgataac

SEQ ID NO: 67866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaagagaaggtatgataa

SEQ ID NO: 67867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagtccttttaaagagaag

SEQ ID NO: 67868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattaatagtccttttaaag

SEQ ID NO: 67869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattcaattaatagtccttt

SEQ ID NO: 67870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattcaattaatagtcctt

SEQ ID NO: 67871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtttacattcaattaatag

SEQ ID NO: 67872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatgtttacattcaattaa

SEQ ID NO: 67873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttatgtttacattcaatt

SEQ ID NO: 67874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgttatgtttacattcaa

SEQ ID NO: 67875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagattctctgttatgttt

SEQ ID NO: 67876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagagattctctgttatgtt

SEQ ID NO: 67877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgtttgagagattctct

SEQ ID NO: 67878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggacccattaaaatgtttga

SEQ ID NO: 67879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgggacccattaaaatgt

SEQ ID NO: 67880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcactgggacccattaaaa

SEQ ID NO: 67881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcactgggacccattaaa

SEQ ID NO: 67882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgaaaccacccaaaagaaa

SEQ ID NO: 67883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtaatgcaccatgagagca

SEQ ID NO: 67884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtaatgcaccatgagagc

SEQ ID NO: 67885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgtaatgcaccatgagag

SEQ ID NO: 67886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcatagactttatgtaatg

SEQ ID NO: 67887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatgatgaaactcagcata

SEQ ID NO: 67888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacatgatgaaactcagcat

SEQ ID NO: 67889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttaacatgatgaaactca

SEQ ID NO: 67890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtttaacatgatgaaactc

SEQ ID NO: 67891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtttaacatgatgaaact

SEQ ID NO: 67892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagctttggtttaacatga

SEQ ID NO: 67893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagagctttggtttaacatg

SEQ ID NO: 67894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagagctttggtttaacat

SEQ ID NO: 67895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagagctttggtttaaca

SEQ ID NO: 67896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagagctttggtttaac

SEQ ID NO: 67897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgagagctttggtttaa

SEQ ID NO: 67898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgagagctttggttta

SEQ ID NO: 67899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgagagctttggttt

SEQ ID NO: 67900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttgagagctttggtt

SEQ ID NO: 67901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttgagagctttggt

SEQ ID NO: 67902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttgagagctttgg

SEQ ID NO: 67903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttgagagctttg

SEQ ID NO: 67904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttgagagcttt

SEQ ID NO: 67905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttgagagctt

SEQ ID NO: 67906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttgagagct

SEQ ID NO: 67907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttgagagc

SEQ ID NO: 67908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttgagag

SEQ ID NO: 67909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttttgaga

SEQ ID NO: 67910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttgag

SEQ ID NO: 67911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttttttga

SEQ ID NO: 67912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttg

SEQ ID NO: 67913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttttttttttttttttt

SEQ ID NO: 67914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttttttttttttttttttt

SEQ ID NO: 67915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttttttttttttttttt

SEQ ID NO: 67916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccttttttttttttttttt

SEQ ID NO: 67917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttcctttttttttttttt

SEQ ID NO: 67918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttccttttttttttttt

SEQ ID NO: 67919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctttcctttttttttttt

SEQ ID NO: 67920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcctttcctttttttttt

SEQ ID NO: 67921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcctttccttttttttt

SEQ ID NO: 67922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttcctttcctttttttt

SEQ ID NO: 67923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttcctttccttttttt

SEQ ID NO: 67924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctttcctttcctttttt

SEQ ID NO: 67925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttctttcctttccttttt

SEQ ID NO: 67926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttctttcctttccttt

SEQ ID NO: 67927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttttctttcctttcctt

SEQ ID NO: 67928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtggtcagtggtttcttt

SEQ ID NO: 67929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagtggtcagtggtttctt

SEQ ID NO: 67930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagtggtcagtggtttct

SEQ ID NO: 67931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaagtggtcagtggtttc

SEQ ID NO: 67932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttttgaagtggtcagtgg

SEQ ID NO: 67933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaatagtctgtcttttga

SEQ ID NO: 67934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgaatagtctgtcttttg

SEQ ID NO: 67935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgaatagtctgtctttt

SEQ ID NO: 67936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatgaatagtctgtcttt

SEQ ID NO: 67937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtttttaatgaatagtct

SEQ ID NO: 67938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatggtttttaatgaatag

SEQ ID NO: 67939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcatgctgttatggttttt

SEQ ID NO: 67940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattgatcatgctgttatgg

SEQ ID NO: 67941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attatattgatcatgctgtt

SEQ ID NO: 67942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaattatattgatcatg

SEQ ID NO: 67943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattaattatattgatcat

SEQ ID NO: 67944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaattaattatattgatca

SEQ ID NO: 67945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaattaattatattgatc

SEQ ID NO: 67946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataatcaatttttaaattaa

SEQ ID NO: 67947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cataatcaatttttaaatta

SEQ ID NO: 67948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcataatcaatttttaaatt

SEQ ID NO: 67949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttcataatcaatttttaa

SEQ ID NO: 67950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttttcataatcaattttta

SEQ ID NO: 67951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaatggtgaaaaaagctt

SEQ ID NO: 67952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgttaagaaatggtgaaaa

SEQ ID NO: 67953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgttaagaaatggtgaaa

SEQ ID NO: 67954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttgatgttaagaaatgg

SEQ ID NO: 67955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttatatttgatgttaagaa

SEQ ID NO: 67956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttatatttgatgttaaga

SEQ ID NO: 67957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagttatatttgatgttaag

SEQ ID NO: 67958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttagttatatttgatgtt

SEQ ID NO: 67959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttagttatatttgatgt

SEQ ID NO: 67960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaaatatttgttttagtta

SEQ ID NO: 67961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaagataatgttaacaaat

SEQ ID NO: 67962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaagataatgttaacaaa

SEQ ID NO: 67963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaaagataatgttaacaa

SEQ ID NO: 67964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggaaagataatgttaaca

SEQ ID NO: 67965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttggaaagataatgttaa

SEQ ID NO: 67966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttggaaagataatgtta

SEQ ID NO: 67967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttttggaaagataatgtt

SEQ ID NO: 67968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcttttggaaagataatg

SEQ ID NO: 67969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcttttggaaagataat

SEQ ID NO: 67970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttcttttggaaagataa

SEQ ID NO: 67971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttcttttggaaagata

SEQ ID NO: 67972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctttcttttggaaagat

SEQ ID NO: 67973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttctttcttttggaaa

SEQ ID NO: 67974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttctttcttttggaa

SEQ ID NO: 67975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttctttcttttgga

SEQ ID NO: 67976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattttttctttcttttgg

SEQ ID NO: 67977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgacttttattttttctttc

SEQ ID NO: 67978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgacttttattttttcttt

SEQ ID NO: 67979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgacttttattttttctt

SEQ ID NO: 67980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctttgtgacttttatttttt

SEQ ID NO: 67981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaacacaataaccaactcc

SEQ ID NO: 67982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtaacacaataaccaactc

SEQ ID NO: 67983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtaacacaataaccaact

SEQ ID NO: 67984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actttagtaacacaataacc

SEQ ID NO: 67985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taactttagtaacacaataa

SEQ ID NO: 67986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attctaactttagtaacaca

SEQ ID NO: 67987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataattaattctaactttag

SEQ ID NO: 67988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaataactaataattaat

SEQ ID NO: 67989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctataaaataactaataatt

SEQ ID NO: 67990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctataaaataactaataat

SEQ ID NO: 67991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acccccttcctataaaataa

SEQ ID NO: 67992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattcacccccttcctataa

SEQ ID NO: 67993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattcacccccttcctata

SEQ ID NO: 67994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtattcacccccttcctat

SEQ ID NO: 67995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatgttttgtattcaccc

SEQ ID NO: 67996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaatgttttgtattcacc

SEQ ID NO: 67997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaaatgttttgtattcac

SEQ ID NO: 67998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttcaaaatgttttgtatt

SEQ ID NO: 67999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctttcaaaatgttttgtat

SEQ ID NO: 68000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaggagaagccaaatcatc

SEQ ID NO: 68001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtaggagaagccaaatcat

SEQ ID NO: 68002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttggtaggagaagccaaa

SEQ ID NO: 68003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaacttggtaggagaagcc

SEQ ID NO: 68004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttaacttggtaggagaag

SEQ ID NO: 68005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgttaacttggtaggagaa

SEQ ID NO: 68006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgttaacttggtaggaga

SEQ ID NO: 68007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgttaacttggtaggag

SEQ ID NO: 68008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaaataataatggtaata

SEQ ID NO: 68009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctcaaaaaataataatggt

SEQ ID NO: 68010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtctcaaaaaataataatg

SEQ ID NO: 68011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaacaaagtgagactctgt

SEQ ID NO: 68012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcctggcaacaaagtgag

SEQ ID NO: 68013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactccagcctggcaacaaa

SEQ ID NO: 68014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgcactccagcctggcaac

SEQ ID NO: 68015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctactgcactccagcctggc

SEQ ID NO: 68016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatcctgctactgcactcc

SEQ ID NO: 68017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtgagctgagatcctgct

SEQ ID NO: 68018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacccaggaggcagaggttg

SEQ ID NO: 68019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaacccaggaggcagaggtt

SEQ ID NO: 68020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcaggagaatcgcttgaa

SEQ ID NO: 68021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagaggctgaggcaggagaa

SEQ ID NO: 68022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcaagaggctgaggcagga

SEQ ID NO: 68023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagtcccagctactcaagag

SEQ ID NO: 68024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtggtgagcgcctgtagtcc

SEQ ID NO: 68025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcctggtggtgagcgcctg

SEQ ID NO: 68026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctgagcctggtggtgagcg

SEQ ID NO: 68027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatacaaaaattagctga

SEQ ID NO: 68028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaaaatacaaaaattagc

SEQ ID NO: 68029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactaaaaatacaaaaatta

SEQ ID NO: 68030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctactaaaaatacaaaaatt

SEQ ID NO: 68031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acatggtgaaatcccgtttc

SEQ ID NO: 68032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctaacatggtgaaatcccg

SEQ ID NO: 68033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaaggtcaagagatcgaga

SEQ ID NO: 68034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacaaggtcaagagatcgag

SEQ ID NO: 68035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacaaggtcaagagatcga

SEQ ID NO: 68036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcacaaggtcaagagatcg

SEQ ID NO: 68037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcacaaggtcaagagatc

SEQ ID NO: 68038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcgaaaaataacctttttca

SEQ ID NO: 68039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagttagcgaaaaataacct

SEQ ID NO: 68040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataatcaggattagagtta

SEQ ID NO: 68041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaattacataatcaggat

SEQ ID NO: 68042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaattagtaaattacata

SEQ ID NO: 68043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gattatcaaattagtaaatt

SEQ ID NO: 68044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agattatcaaattagtaaat

SEQ ID NO: 68045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagattatcaaattagtaaa

SEQ ID NO: 68046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagattatcaaattagtaa

SEQ ID NO: 68047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttttagattatcaaattag

SEQ ID NO: 68048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgctgcttttagattatcaa

SEQ ID NO: 68049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattgtgctgcttttagatt

SEQ ID NO: 68050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattgtgctgcttttagat

SEQ ID NO: 68051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatattgtgctgcttttaga

SEQ ID NO: 68052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtggttttatattgtgctg

SEQ ID NO: 68053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtctatgtggttttatatt

SEQ ID NO: 68054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtctatgtggttttatat

SEQ ID NO: 68055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggtctatgtggttttata

SEQ ID NO: 68056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgggtctatgtggtttta

SEQ ID NO: 68057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaacatgacatgactcttt

SEQ ID NO: 68058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataattatgaacatgacat

SEQ ID NO: 68059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaacctatataattatgaa

SEQ ID NO: 68060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcaacctatataattatga

SEQ ID NO: 68061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgacttggcaacctatat

SEQ ID NO: 68062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacatgacttggcaacctat

SEQ ID NO: 68063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttctacatgacttggcaac

SEQ ID NO: 68064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agttctacatgacttggcaa

SEQ ID NO: 68065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tccttagttctacatgactt

SEQ ID NO: 68066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatccttagttctacatga

SEQ ID NO: 68067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actatccttagttctacatg

SEQ ID NO: 68068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactatccttagttctacat

SEQ ID NO: 68069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttactatccttagttctac

SEQ ID NO: 68070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctttactatccttagttc

SEQ ID NO: 68071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccctgttctttactatcctt

SEQ ID NO: 68072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccctgttctttactatcct

SEQ ID NO: 68073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgtatatcttgccctgttct

SEQ ID NO: 68074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccgtatatcttgccctgttc

SEQ ID NO: 68075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttccgtatatcttgccctg

SEQ ID NO: 68076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agactgcttccgtatatctt

SEQ ID NO: 68077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagactgcttccgtatatct

SEQ ID NO: 68078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagacttcagactgcttccg

SEQ ID NO: 68079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagacttcagactgcttcc

SEQ ID NO: 68080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttgaagacttcagactg

SEQ ID NO: 68081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttgaagacttcagact

SEQ ID NO: 68082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtatttgaagacttcagac

SEQ ID NO: 68083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttgtatttgaagacttca

SEQ ID NO: 68084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttactttgtatttgaagact

SEQ ID NO: 68085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtctattactttgtatttg

SEQ ID NO: 68086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtgtctattactttgtatt

SEQ ID NO: 68087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctctgtgtctattactttg

SEQ ID NO: 68088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agctctgtgtctattacttt

SEQ ID NO: 68089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttagctctgtgtctattac

SEQ ID NO: 68090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttccttagctctgtgtctat

SEQ ID NO: 68091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcaaggttgttccttagct

SEQ ID NO: 68092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgcaaggttgttccttagc

SEQ ID NO: 68093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttatgcaaggttgttcctta

SEQ ID NO: 68094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctcttatgcaaggttgttc

SEQ ID NO: 68095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccctcttatgcaaggttgt

SEQ ID NO: 68096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctccctcttatgcaaggtt

SEQ ID NO: 68097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctccctcttatgcaaggt

SEQ ID NO: 68098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctccctcttatgcaagg

SEQ ID NO: 68099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctctccctcttatgcaag

SEQ ID NO: 68100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accttttctctccctcttat

SEQ ID NO: 68101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaccttttctctccctct

SEQ ID NO: 68102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcaccttttctctccctc

SEQ ID NO: 68103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttattcaccttttctctccc

SEQ ID NO: 68104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcttattcaccttttctct

SEQ ID NO: 68105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttcctcttattcacctttt

SEQ ID NO: 68106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catctggttcctcttattca

SEQ ID NO: 68107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attgcatctggttcctctta

SEQ ID NO: 68108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgattgcatctggttcct

SEQ ID NO: 68109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgattgcatctggttcc

SEQ ID NO: 68110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgtatttcattgattgcat

SEQ ID NO: 68111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaatgtatttcattgattg

SEQ ID NO: 68112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actaatgtatttcattgatt

SEQ ID NO: 68113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactaatgtatttcattgat

SEQ ID NO: 68114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcactttactaatgtatttc

SEQ ID NO: 68115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataattatcactttactaat

SEQ ID NO: 68116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cataattatcactttactaa

SEQ ID NO: 68117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcttcataattatcacttt

SEQ ID NO: 68118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcttcataattatcactt

SEQ ID NO: 68119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttcagcttcataattatc

SEQ ID NO: 68120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attcatttcagcttcataat

SEQ ID NO: 68121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgattcatttcagcttcat

SEQ ID NO: 68122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgattcatttcagcttca

SEQ ID NO: 68123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acatttgttgattcatttca

SEQ ID NO: 68124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagtctcacatttgttgat

SEQ ID NO: 68125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcatagtctcacatttgtt

SEQ ID NO: 68126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgttcatagtctcacattt

SEQ ID NO: 68127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgttcatagtctcacatt

SEQ ID NO: 68128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgttcatagtctcacat

SEQ ID NO: 68129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacgattttgttgttcata

SEQ ID NO: 68130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagataaatgttaaaacgat

SEQ ID NO: 68131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgaagataaatgttaaaac

SEQ ID NO: 68132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgaagataaatgttaaaa

SEQ ID NO: 68133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgaagataaatgttaaa

SEQ ID NO: 68134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactgaagataaatgttaa

SEQ ID NO: 68135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatccaagtagcatgttttt

SEQ ID NO: 68136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgaagtatgaaaaagaat

SEQ ID NO: 68137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaggtaacagaaaaaatta

SEQ ID NO: 68138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctgaaaggtaacagaaaaa

SEQ ID NO: 68139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctacctgaaaggtaacagaa

SEQ ID NO: 68140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctacctgaaaggtaacag

SEQ ID NO: 68141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagagatctctgctacctga

SEQ ID NO: 68142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctccagagatctctgcta

SEQ ID NO: 68143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacctccagagatctctgct

SEQ ID NO: 68144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagcaatgtttcacctcca

SEQ ID NO: 68145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaatcaatgccagttcagag

SEQ ID NO: 68146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggctagaatcaatgccagtt

SEQ ID NO: 68147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caagagctgggctagaatca

SEQ ID NO: 68148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtctacaagagctgggctag

SEQ ID NO: 68149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaattggtctacaagagct

SEQ ID NO: 68150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagttggtaattggtctac

SEQ ID NO: 68151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaagttggtaattggtcta

SEQ ID NO: 68152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttacaagttggtaattggt

SEQ ID NO: 68153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttacaagttggtaattgg

SEQ ID NO: 68154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagaatgaagaatcatgaa

SEQ ID NO: 68155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcagaatgaagaatcatga

SEQ ID NO: 68156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaagcatgggcttgtcaga

SEQ ID NO: 68157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacatgaagactgagaagca

SEQ ID NO: 68158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacatgaagactgagaagc

SEQ ID NO: 68159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaatgcatagtttccacat

SEQ ID NO: 68160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaactggaaatgcatagtt

SEQ ID NO: 68161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaaactggaaatgcatagt

SEQ ID NO: 68162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtgcttaaaaactggaaat

SEQ ID NO: 68163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacattgggtgcttaaaaac

SEQ ID NO: 68164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggattgaacattgggtgc

SEQ ID NO: 68165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgatggattgaacattggg

SEQ ID NO: 68166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgatggattgaacattgg

SEQ ID NO: 68167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagggatttgttgatggatt

SEQ ID NO: 68168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagctgaagggatttgttga

SEQ ID NO: 68169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagttagagctgaagggatt

SEQ ID NO: 68170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagttagagctgaagggat

SEQ ID NO: 68171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagttagagctgaaggga

SEQ ID NO: 68172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtatattttgaagttagag

SEQ ID NO: 68173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatagtgagggtgtgacatg

SEQ ID NO: 68174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatagtgagggtgtgacat

SEQ ID NO: 68175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatagtgagggtgtgaca

SEQ ID NO: 68176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtatggtagagttttgtata

SEQ ID NO: 68177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gactagtatggtagagtttt

SEQ ID NO: 68178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agactagtatggtagagttt

SEQ ID NO: 68179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cataaatccaggtgagaggt

SEQ ID NO: 68180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcataaatccaggtgagag

SEQ ID NO: 68181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcataaatccaggtgaga

SEQ ID NO: 68182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagtttctgcataaatccag

SEQ ID NO: 68183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggagtttctgcataaatcca

SEQ ID NO: 68184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggagtttctgcataaatc

SEQ ID NO: 68185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttggagtttctgcataaat

SEQ ID NO: 68186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagatttcttggagtttct

SEQ ID NO: 68187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagtggaagggcgaatagc

SEQ ID NO: 68188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagagtggaagggcgaatag

SEQ ID NO: 68189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaatgtgcaatcttaagag

SEQ ID NO: 68190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatctcacaatgtgcaatc

SEQ ID NO: 68191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatctcacaatgtgcaat

SEQ ID NO: 68192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatctcacaatgtgcaa

SEQ ID NO: 68193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaggatgtgattttaaaat

SEQ ID NO: 68194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaacattataaggatgtg

SEQ ID NO: 68195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagaacattataaggatgt

SEQ ID NO: 68196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagacatttgaagaacatt

SEQ ID NO: 68197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagtgtagatcagagatg

SEQ ID NO: 68198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaagtgtagatcagagat

SEQ ID NO: 68199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaagtgtagatcagaga

SEQ ID NO: 68200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaagtgtagatcagag

SEQ ID NO: 68201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttaaaaagtgtagatca

SEQ ID NO: 68202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caacaaacaaacaaataaaa

SEQ ID NO: 68203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctccaacaaacaaacaaat

SEQ ID NO: 68204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtctccaacaaacaaacaa

SEQ ID NO: 68205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacgacagaggaagactctg

SEQ ID NO: 68206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcctggacgacagaggaa

SEQ ID NO: 68207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactccagcctggacgacag

SEQ ID NO: 68208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgccactgcactccagcctg

SEQ ID NO: 68209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtgagccaagattgtgcc

SEQ ID NO: 68210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatccaggaggcagaggttg

SEQ ID NO: 68211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatccaggaggcagaggtt

SEQ ID NO: 68212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgaatccaggaggcagag

SEQ ID NO: 68213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcacgagaattacttgaa

SEQ ID NO: 68214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaggctgaggcacgagaat

SEQ ID NO: 68215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgaggctgaggcacgagaa

SEQ ID NO: 68216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgtgaggctgaggcacga

SEQ ID NO: 68217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taatcccagctacttgtgag

SEQ ID NO: 68218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgatacatgcctataatcc

SEQ ID NO: 68219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtgatacatgcctataatc

SEQ ID NO: 68220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcttggtgatacatgccta

SEQ ID NO: 68221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgatcttggtgatacatg

SEQ ID NO: 68222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaatgaaaaaaaaattaat

SEQ ID NO: 68223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgaaaatgaaaaaaaaatt

SEQ ID NO: 68224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgaaaatgaaaaaaaaat

SEQ ID NO: 68225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgaaaatgaaaaaaaaa

SEQ ID NO: 68226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactgaaaatgaaaaaaaa

SEQ ID NO: 68227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccaacgtagcgaaacccca

SEQ ID NO: 68228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagaccagcctggccaacgt

SEQ ID NO: 68229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggccaggagttcaagacca

SEQ ID NO: 68230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggccaggagttcaagacc

SEQ ID NO: 68231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggccgaggtgggcgatc

SEQ ID NO: 68232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaggccgaggtgggcgat

SEQ ID NO: 68233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggaggccgaggtgggcga

SEQ ID NO: 68234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagtactttgggaggccgag

SEQ ID NO: 68235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taattccagtactttgggag

SEQ ID NO: 68236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acacctataattccagtact

SEQ ID NO: 68237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtgaagtggctcacaccta

SEQ ID NO: 68238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggtcagaggctgggtgaag

SEQ ID NO: 68239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagttaaggtcagaggctg

SEQ ID NO: 68240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaaaaaccaagaggccaaa

SEQ ID NO: 68241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaaaaaccaagaggccaa

SEQ ID NO: 68242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcagagtaatgaaggcaca

SEQ ID NO: 68243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggcagagtaatgaaggcac

SEQ ID NO: 68244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggcagagtaatgaaggca

SEQ ID NO: 68245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagggggccgtgcaaatata

SEQ ID NO: 68246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgtgatgtaaagaaaattga

SEQ ID NO: 68247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccgtgatgtaaagaaaattg

SEQ ID NO: 68248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccgtgatgtaaagaaaat

SEQ ID NO: 68249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttccgtgatgtaaagaaaa

SEQ ID NO: 68250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaggtggcgtttcttccg

SEQ ID NO: 68251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctataaaggtggcgtttct

SEQ ID NO: 68252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcagagaaagcctgcctat

SEQ ID NO: 68253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaatgaatgattggtcaga

SEQ ID NO: 68254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcacataaatatgctatcaa

SEQ ID NO: 68255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctagcacataaatatgctat

SEQ ID NO: 68256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actagcacataaatatgcta

SEQ ID NO: 68257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggagaaggtatatggaaaa

SEQ ID NO: 68258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagaaacatatcaagatgta

SEQ ID NO: 68259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgaagaaacatatcaagat

SEQ ID NO: 68260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgaagaaacatatcaaga

SEQ ID NO: 68261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaacaaaacaatacccctt

SEQ ID NO: 68262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagggagatggagctgtgaa

SEQ ID NO: 68263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caggcactggagggagatgg

SEQ ID NO: 68264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgccaggtccagttccag

SEQ ID NO: 68265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatacctgtgtgccaggtcc

SEQ ID NO: 68266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaatacctgtgtgccagg

SEQ ID NO: 68267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagtaaacaaataattatta

SEQ ID NO: 68268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttccagtaaacaaataatta

SEQ ID NO: 68269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attccagtaaacaaataatt

SEQ ID NO: 68270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattccagtaaacaaataat

SEQ ID NO: 68271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttattccagtaaacaaata

SEQ ID NO: 68272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acataatcattctttattcc

SEQ ID NO: 68273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaccgtgtattcacataatc

SEQ ID NO: 68274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaccgtgtattcacataat

SEQ ID NO: 68275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaccgtgtattcacataa

SEQ ID NO: 68276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcctttcaaccgtgtattca

SEQ ID NO: 68277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcctttcaaccgtgtattc

SEQ ID NO: 68278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttagcctttcaaccgtgta

SEQ ID NO: 68279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttagcctttcaaccgtgt

SEQ ID NO: 68280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgaagcagccaatttgct

SEQ ID NO: 68281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataaattcagtgaagcagcc

SEQ ID NO: 68282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagcctaataaattcagtga

SEQ ID NO: 68283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatctgtagcctaataaatt

SEQ ID NO: 68284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggatctgtagcctaataaa

SEQ ID NO: 68285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atacagtctctggatctgta

SEQ ID NO: 68286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catacagtctctggatctgt

SEQ ID NO: 68287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcagagacttcatacagt

SEQ ID NO: 68288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgctccagcagagacttc

SEQ ID NO: 68289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtgctccagcagagactt

SEQ ID NO: 68290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtgctccagcagagact

SEQ ID NO: 68291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatgtgctccagcagagac

SEQ ID NO: 68292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtcacatcccttttatgtg

SEQ ID NO: 68293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgagtcacatcccttttatg

SEQ ID NO: 68294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agggagcatatatctctgag

SEQ ID NO: 68295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgagggagcatatatctct

SEQ ID NO: 68296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgagggagcatatatctc

SEQ ID NO: 68297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatttactgagggagcata

SEQ ID NO: 68298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaccattgaaatttactgag

SEQ ID NO: 68299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaccattgaaatttactga

SEQ ID NO: 68300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcttggaccattgaaattt

SEQ ID NO: 68301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caatgaacctgggcttggac

SEQ ID NO: 68302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaatgaacctgggcttgga

SEQ ID NO: 68303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaatgaacctgggcttgg

SEQ ID NO: 68304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggaaacacattttccaatg

SEQ ID NO: 68305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggccagtatagaagaaata

SEQ ID NO: 68306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaactgaggccagtataga

SEQ ID NO: 68307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaaactgaggccagtatag

SEQ ID NO: 68308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttccaaactgaggccagta

SEQ ID NO: 68309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgcttccaaactgaggcc

SEQ ID NO: 68310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcattgcttccaaactgag

SEQ ID NO: 68311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agattattcattgcttccaa

SEQ ID NO: 68312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgagattattcattgcttcc

SEQ ID NO: 68313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaatactctgagattattc

SEQ ID NO: 68314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgaatactctgagattatt

SEQ ID NO: 68315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgaatactctgagattat

SEQ ID NO: 68316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtgaatactctgagatta

SEQ ID NO: 68317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaacatcaatgaaaatact

SEQ ID NO: 68318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcctataaacatcaatgaa

SEQ ID NO: 68319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcctataaacatcaatga

SEQ ID NO: 68320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatcctataaacatcaatg

SEQ ID NO: 68321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatcctataaacatcaat

SEQ ID NO: 68322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaatcctataaacatcaa

SEQ ID NO: 68323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaatcctataaacatca

SEQ ID NO: 68324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taataagatataatacaaag

SEQ ID NO: 68325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttataataagatataataca

SEQ ID NO: 68326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taggtgctgttataataaga

SEQ ID NO: 68327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agactgtaggtgctgttata

SEQ ID NO: 68328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagactgtaggtgctgttat

SEQ ID NO: 68329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcagactgtaggtgctgt

SEQ ID NO: 68330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgctatttcagactgtaggt

SEQ ID NO: 68331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atactatgctatttcagact

SEQ ID NO: 68332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagaaagtattaatactatg

SEQ ID NO: 68333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acagaaagtattaatactat

SEQ ID NO: 68334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttacagaaagtattaatact

SEQ ID NO: 68335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactcttacagaaagtatta

SEQ ID NO: 68336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaactcttacagaaagtatt

SEQ ID NO: 68337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaaacttaaactcttaca

SEQ ID NO: 68338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaaaaacttaaactcttac

SEQ ID NO: 68339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaccaaaaaatgacttcaa

SEQ ID NO: 68340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaccaaaaaatgacttca

SEQ ID NO: 68341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtttcaaaccaaaaaatg

SEQ ID NO: 68342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagtttcaaaccaaaaaat

SEQ ID NO: 68343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaatcaacttaaagtttca

SEQ ID NO: 68344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcaatcaacttaaagtttc

SEQ ID NO: 68345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggcttatcaatcaacttaaa

SEQ ID NO: 68346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaagaagttgggcttatca

SEQ ID NO: 68347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggataactagaaagaagttg

SEQ ID NO: 68348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggataactagaaagaagt

SEQ ID NO: 68349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattctaggataactagaa

SEQ ID NO: 68350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaattctaggataactaga

SEQ ID NO: 68351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaatgatcatgacttaaaa

SEQ ID NO: 68352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaatgatcatgacttaaa

SEQ ID NO: 68353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgaatgatcatgacttaa

SEQ ID NO: 68354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttatgaatgatcatgac

SEQ ID NO: 68355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcattttatgaatgatcat

SEQ ID NO: 68356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctattcattttatgaatga

SEQ ID NO: 68357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctattcattttatgaatg

SEQ ID NO: 68358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccctattcattttatgaat

SEQ ID NO: 68359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaagattttccctattcat

SEQ ID NO: 68360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgctaccaagattttccct

SEQ ID NO: 68361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattgatgctaccaagattt

SEQ ID NO: 68362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattgatgctaccaagatt

SEQ ID NO: 68363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttgtattgatgctacca

SEQ ID NO: 68364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatttgtattgatgctacc

SEQ ID NO: 68365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcagtatatagacttaaatt

SEQ ID NO: 68366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagcagtatatagacttaa

SEQ ID NO: 68367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attagcagtatatagactta

SEQ ID NO: 68368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagaaatttattagcagtat

SEQ ID NO: 68369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcaagaaatttattagcag

SEQ ID NO: 68370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcctcaagaaatttattag

SEQ ID NO: 68371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcaacatgtatggcctgct

SEQ ID NO: 68372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcaacatgtatggcctgc

SEQ ID NO: 68373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaatttcatcaacatgtat

SEQ ID NO: 68374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaatttcatcaacatgta

SEQ ID NO: 68375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagagatttaagaatttcat

SEQ ID NO: 68376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtgtccatgttacagag

SEQ ID NO: 68377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagtgtccatgttacaga

SEQ ID NO: 68378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaagtgtccatgttacag

SEQ ID NO: 68379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttaaaagtgtccatgtta

SEQ ID NO: 68380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttaaaagtgtccatgtt

SEQ ID NO: 68381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taagcaaatgcacagtttcc

SEQ ID NO: 68382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgctataagcaaatgcaca

SEQ ID NO: 68383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaattagtgctataagcaaa

SEQ ID NO: 68384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgaaattagtgctataagc

SEQ ID NO: 68385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgaaattagtgctataag

SEQ ID NO: 68386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcttgctgaaattagtgct

SEQ ID NO: 68387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgcttgctgaaattagtgc

SEQ ID NO: 68388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgcttgctgaaattagtg

SEQ ID NO: 68389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtaagaagcaaaggtgtac

SEQ ID NO: 68390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtaagaagcaaaggtgta

SEQ ID NO: 68391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtaagaagcaaaggtgt

SEQ ID NO: 68392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatacacaccaaatatcatt

SEQ ID NO: 68393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatacacaccaaatatcat

SEQ ID NO: 68394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatacacaccaaatatca

SEQ ID NO: 68395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaaatacacaccaaatat

SEQ ID NO: 68396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttaaatacacaccaaata

SEQ ID NO: 68397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttaaatacacaccaaat

SEQ ID NO: 68398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaagagtgcatggattttc

SEQ ID NO: 68399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaataaagacatcagcaa

SEQ ID NO: 68400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcaaaatgattggaaaata

SEQ ID NO: 68401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgggttaagcaaaatgatt

SEQ ID NO: 68402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taacattcatgggttaagca

SEQ ID NO: 68403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataacattcatgggttaagc

SEQ ID NO: 68404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttataacattcatgggttaa

SEQ ID NO: 68405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttataacattcatgggtta

SEQ ID NO: 68406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtttcttataacattcatgg

SEQ ID NO: 68407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aactggtttcttataacatt

SEQ ID NO: 68408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaactggtttcttataaca

SEQ ID NO: 68409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaactggtttcttataac

SEQ ID NO: 68410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcaactggtttcttataa

SEQ ID NO: 68411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgtccaagattttctcaa

SEQ ID NO: 68412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtgtccaagattttctca

SEQ ID NO: 68413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagtgtccaagattttctc

SEQ ID NO: 68414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttcagtgtccaagatttt

SEQ ID NO: 68415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctttcagtgtccaagattt

SEQ ID NO: 68416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaatcatcgacttgcttt

SEQ ID NO: 68417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaaatcatcgacttgctt

SEQ ID NO: 68418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaaaatcatcgacttgct

SEQ ID NO: 68419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaaaatcatcgacttgc

SEQ ID NO: 68420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgaaaaatcatcgacttg

SEQ ID NO: 68421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtattttttgaaaaatcatc

SEQ ID NO: 68422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcattagtattttttgaaa

SEQ ID NO: 68423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctcagcattagtattttt

SEQ ID NO: 68424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accctcagcattagtatttt

SEQ ID NO: 68425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtcatgggcttaccctcagc

SEQ ID NO: 68426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctagtcatgggcttaccct

SEQ ID NO: 68427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctagtcatgggcttaccc

SEQ ID NO: 68428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgacttatctagtcatggg

SEQ ID NO: 68429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatagcacagatgctaatg

SEQ ID NO: 68430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacagaagttatgatagcac

SEQ ID NO: 68431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atacagaagttatgatagca

SEQ ID NO: 68432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaatcttatacagaagtta

SEQ ID NO: 68433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaacaatcttatacagaag

SEQ ID NO: 68434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttaacaatcttatacaga

SEQ ID NO: 68435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggattctgttaacaatct

SEQ ID NO: 68436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaggattctgttaacaatc

SEQ ID NO: 68437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcaaggattctgttaacaa

SEQ ID NO: 68438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttcaaggattctgttaa

SEQ ID NO: 68439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcttcaaggattctgtta

SEQ ID NO: 68440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattcttcaaggattctgt

SEQ ID NO: 68441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttattcttcaaggattctg

SEQ ID NO: 68442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttattcttcaaggattct

SEQ ID NO: 68443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttattcttcaaggattc

SEQ ID NO: 68444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttttcttattcttcaagga

SEQ ID NO: 68445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacttttcttattcttcaag

SEQ ID NO: 68446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctacttttcttattcttcaa

SEQ ID NO: 68447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctacttttcttattcttc

SEQ ID NO: 68448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttctacttttcttattctt

SEQ ID NO: 68449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcttctacttttcttatt

SEQ ID NO: 68450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttcttctacttttcttat

SEQ ID NO: 68451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcttccttcttctacttttc

SEQ ID NO: 68452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcacagtgcctatcttcctt

SEQ ID NO: 68453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctagcacagtgcctatcttc

SEQ ID NO: 68454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actagcacagtgcctatctt

SEQ ID NO: 68455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaacttactagcacagtgc

SEQ ID NO: 68456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaggatcaaataagataat

SEQ ID NO: 68457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaaatggggatatcagcat

SEQ ID NO: 68458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctgtaaaatggggatatc

SEQ ID NO: 68459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatatctcatctgtaaaat

SEQ ID NO: 68460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagatatctcatctgtaaaa

SEQ ID NO: 68461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcagatatctcatctgtaa

SEQ ID NO: 68462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcttcagatatctcatctg

SEQ ID NO: 68463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttcttcagatatctcatct

SEQ ID NO: 68464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatcttgttcttcagatat

SEQ ID NO: 68465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatcttgttcttcagata

SEQ ID NO: 68466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcacaatttaaaatcttgt

SEQ ID NO: 68467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgcacaatttaaaatcttg

SEQ ID NO: 68468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgagaacttgtgcacaattt

SEQ ID NO: 68469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctgtgagaacttgtgcaca

SEQ ID NO: 68470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgcctgtgagaacttgtg

SEQ ID NO: 68471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctgcctgtgagaacttgt

SEQ ID NO: 68472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccgacttatctgcctgtgag

SEQ ID NO: 68473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccgacttatctgcctgtga

SEQ ID NO: 68474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttgccgacttatctgcct

SEQ ID NO: 68475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatttgccgacttatctgc

SEQ ID NO: 68476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataaacatatgttctaattt

SEQ ID NO: 68477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagcctgataaacatatgtt

SEQ ID NO: 68478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggagcctgataaacatatgt

SEQ ID NO: 68479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggagcctgataaacatatg

SEQ ID NO: 68480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaactttggagcctgataaa

SEQ ID NO: 68481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caatgtaatacagtaataca

SEQ ID NO: 68482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtaaaaatacaagcccaga

SEQ ID NO: 68483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatcatctaggtaaaaatac

SEQ ID NO: 68484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacaagtattgtatcatcta

SEQ ID NO: 68485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgaacaagtattgtatca

SEQ ID NO: 68486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagggataatgcagtattg

SEQ ID NO: 68487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcagggataatgcagtatt

SEQ ID NO: 68488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatttgtcagggataatgc

SEQ ID NO: 68489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaatttgtcagggataat

SEQ ID NO: 68490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggaatttgtcagggataa

SEQ ID NO: 68491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttctggaatttgtcaggga

SEQ ID NO: 68492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctacttctggaatttgtcag

SEQ ID NO: 68493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actacttctggaatttgtca

SEQ ID NO: 68494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttactacttctggaatttgt

SEQ ID NO: 68495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttactacttctggaatttg

SEQ ID NO: 68496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatttcttactacttctgga

SEQ ID NO: 68497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatgctgaatttcttacta

SEQ ID NO: 68498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatatgctgaatttcttac

SEQ ID NO: 68499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgatatgctgaatttctta

SEQ ID NO: 68500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgatatgctgaatttctt

SEQ ID NO: 68501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatgctttctgatatgctga

SEQ ID NO: 68502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgtatgctttctgatatgc

SEQ ID NO: 68503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcctgtatgctttctgata

SEQ ID NO: 68504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactcctgtatgctttctga

SEQ ID NO: 68505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctactcctgtatgctttctg

SEQ ID NO: 68506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttctactcctgtatgcttt

SEQ ID NO: 68507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taacagtacctccttctact

SEQ ID NO: 68508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaacagtacctccttctac

SEQ ID NO: 68509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaacagtacctccttcta

SEQ ID NO: 68510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttgtaacagtacctcctt

SEQ ID NO: 68511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttttgtaacagtacctcct

SEQ ID NO: 68512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgttttgtaacagtacctc

SEQ ID NO: 68513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtctcttgttttgtaacagt

SEQ ID NO: 68514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtctcttgttttgtaacag

SEQ ID NO: 68515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccttagtctcttgttttgt

SEQ ID NO: 68516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggccttagtctcttgttttg

SEQ ID NO: 68517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttggccttagtctcttg

SEQ ID NO: 68518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatttggccttagtctctt

SEQ ID NO: 68519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacatttggccttagtctct

SEQ ID NO: 68520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttacatttggccttagtct

SEQ ID NO: 68521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatgtaaagttctttacat

SEQ ID NO: 68522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacatgtaaagttctttaca

SEQ ID NO: 68523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttgacatgtaaagttctt

SEQ ID NO: 68524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacttgacatgtaaagttct

SEQ ID NO: 68525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagtccttaacttgacatgt

SEQ ID NO: 68526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggtaaagtctgaagtcctt

SEQ ID NO: 68527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagggtaaagtctgaagtcc

SEQ ID NO: 68528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcctctagggtaaagtctga

SEQ ID NO: 68529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcctctagggtaaagtctg

SEQ ID NO: 68530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatgtgagaatccttggcc

SEQ ID NO: 68531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgcacactaaaatgtgag

SEQ ID NO: 68532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatgcacactaaaatgtga

SEQ ID NO: 68533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaggatttgcatgcacact

SEQ ID NO: 68534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagaggatttgcatgcacac

SEQ ID NO: 68535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagatagggcccaagccctt

SEQ ID NO: 68536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggagatagggcccaagccc

SEQ ID NO: 68537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcaggaactctggagatag

SEQ ID NO: 68538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtcacaagttcatcaggaac

SEQ ID NO: 68539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctagtcacaagttcatcagg

SEQ ID NO: 68540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctagtcacaagttcatcag

SEQ ID NO: 68541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgctagtcacaagttcat

SEQ ID NO: 68542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttgctagtcacaagttca

SEQ ID NO: 68543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttgctagtcacaagttc

SEQ ID NO: 68544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagttttccttgctagtcac

SEQ ID NO: 68545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagttttccttgctagtca

SEQ ID NO: 68546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagacccttaaagttttcc

SEQ ID NO: 68547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagagacccttaaagttttc

SEQ ID NO: 68548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagagacccttaaagtttt

SEQ ID NO: 68549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagactttgagagaccctta

SEQ ID NO: 68550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagctaaagactttgagaga

SEQ ID NO: 68551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctcaagctaaagactttg

SEQ ID NO: 68552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accctcaagctaaagacttt

SEQ ID NO: 68553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccttaccctcaagctaaaga

SEQ ID NO: 68554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgatctaccttaccctcaa

SEQ ID NO: 68555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgatctaccttaccctca

SEQ ID NO: 68556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaacttcatgatctacctt

SEQ ID NO: 68557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagtaacttcatgatctac

SEQ ID NO: 68558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attagtaacttcatgatcta

SEQ ID NO: 68559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattagtaacttcatgatct

SEQ ID NO: 68560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagtctttattagtaacttc

SEQ ID NO: 68561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctccagtctttattagtaac

SEQ ID NO: 68562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctccagtctttattagtaa

SEQ ID NO: 68563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagcttcctccagtctttat

SEQ ID NO: 68564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagcttcctccagtcttta

SEQ ID NO: 68565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatggtttacagcttcctc

SEQ ID NO: 68566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtatggtttacagcttcct

SEQ ID NO: 68567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtatggtttacagcttcc

SEQ ID NO: 68568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaagcaaaaacaaaaacaa

SEQ ID NO: 68569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaagcaaaaacaaaaaca

SEQ ID NO: 68570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaaagcaaaaacaaaaac

SEQ ID NO: 68571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaaagcaaaaacaaaaa

SEQ ID NO: 68572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgaaaagcaaaaacaaaa

SEQ ID NO: 68573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgaaaagcaaaaacaaa

SEQ ID NO: 68574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgaaaagcaaaaacaa

SEQ ID NO: 68575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgaaaagcaaaaaca

SEQ ID NO: 68576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttgaaaagcaaaaac

SEQ ID NO: 68577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttgaaaagcaaaaa

SEQ ID NO: 68578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttgaaaagcaaaa

SEQ ID NO: 68579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttgaaaagcaaa

SEQ ID NO: 68580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataagtttttttttttttga

SEQ ID NO: 68581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataagtttttttttttttg

SEQ ID NO: 68582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagtttaataagttttttt

SEQ ID NO: 68583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaaacattccaagtttaat

SEQ ID NO: 68584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaaacattccaagtttaa

SEQ ID NO: 68585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtaaaacattccaagtt

SEQ ID NO: 68586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgtttgtaaaacattccaa

SEQ ID NO: 68587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcatcaccatctgttgttt

SEQ ID NO: 68588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccattggtcatcaccatct

SEQ ID NO: 68589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caattccccattggtcatca

SEQ ID NO: 68590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaattccccattggtcatc

SEQ ID NO: 68591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttacaattccccattggtc

SEQ ID NO: 68592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtcccagatctgcttacaa

SEQ ID NO: 68593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtcccagatctgcttaca

SEQ ID NO: 68594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgagtcccagatctgctta

SEQ ID NO: 68595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actcttgagtcccagatctg

SEQ ID NO: 68596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acctcactcttgagtcccag

SEQ ID NO: 68597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taacctcactcttgagtccc

SEQ ID NO: 68598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctctaacctcactcttgag

SEQ ID NO: 68599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctctaacctcactcttga

SEQ ID NO: 68600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacctctaacctcactcttg

SEQ ID NO: 68601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatcaatgtctttacctct

SEQ ID NO: 68602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacatcaatgtctttacctc

SEQ ID NO: 68603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaacatcaatgtctttacc

SEQ ID NO: 68604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actcttaacatcaatgtctt

SEQ ID NO: 68605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgactcttaacatcaatgt

SEQ ID NO: 68606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgctattgactcttaacatc

SEQ ID NO: 68607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgctattgactcttaaca

SEQ ID NO: 68608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtgctattgactcttaac

SEQ ID NO: 68609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaagccatttctgtgctat

SEQ ID NO: 68610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaaagccatttctgtgcta

SEQ ID NO: 68611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggcttgaaaagccatttct

SEQ ID NO: 68612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgcatgcctgtggcttgaa

SEQ ID NO: 68613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgcatgcctgtggcttga

SEQ ID NO: 68614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtgtttcatgcatgcctg

SEQ ID NO: 68615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaggtgtttcatgcatgcc

SEQ ID NO: 68616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagctctgaggtgtttcatg

SEQ ID NO: 68617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaagctctgaggtgtttca

SEQ ID NO: 68618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctgaagctctgaggtgtt

SEQ ID NO: 68619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attctgaagctctgaggtgt

SEQ ID NO: 68620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattctgaagctctgaggt

SEQ ID NO: 68621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttattctgaagctctgagg

SEQ ID NO: 68622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttattctgaagctctgag

SEQ ID NO: 68623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttattctgaagctctga

SEQ ID NO: 68624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttttcttattctgaagct

SEQ ID NO: 68625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttatcttttcttattctg

SEQ ID NO: 68626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagttatcttttcttattct

SEQ ID NO: 68627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatcttcagttatcttttct

SEQ ID NO: 68628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccacatgttcaatcttcag

SEQ ID NO: 68629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccccacatgttcaatcttc

SEQ ID NO: 68630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccccacatgttcaatctt

SEQ ID NO: 68631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaataatgatttctcccca

SEQ ID NO: 68632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacatcctgtaaataatgat

SEQ ID NO: 68633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcacatcctgtaaataatg

SEQ ID NO: 68634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcacatcctgtaaataat

SEQ ID NO: 68635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgcacatcctgtaaataa

SEQ ID NO: 68636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgcacatcctgtaaata

SEQ ID NO: 68637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctgcacatcctgtaaat

SEQ ID NO: 68638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgagtattttttctgcaca

SEQ ID NO: 68639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgagtattttttctgcac

SEQ ID NO: 68640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatgagtattttttctgca

SEQ ID NO: 68641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaatgagtattttttctg

SEQ ID NO: 68642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttaatgagtattttttct

SEQ ID NO: 68643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctttaatgagtattttt

SEQ ID NO: 68644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatttctttaatgagtattt

SEQ ID NO: 68645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctatttctttaatgagtat

SEQ ID NO: 68646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctatttctttaatgagt

SEQ ID NO: 68647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctctctatttctttaatg

SEQ ID NO: 68648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttcctctctctatttctt

SEQ ID NO: 68649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagttcctctctctatttc

SEQ ID NO: 68650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagttctgagttcctctctc

SEQ ID NO: 68651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agagttctgagttcctctct

SEQ ID NO: 68652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttagagttctgagttcct

SEQ ID NO: 68653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttagagttctgagttcc

SEQ ID NO: 68654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtcttagagttctgagt

SEQ ID NO: 68655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgtcttagagttctgag

SEQ ID NO: 68656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttgtcttagagttctga

SEQ ID NO: 68657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatttgtcttagagttctg

SEQ ID NO: 68658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcttttatttgtcttagag

SEQ ID NO: 68659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtcttttatttgtcttaga

SEQ ID NO: 68660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtcttttatttgtcttag

SEQ ID NO: 68661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctttggtcttttatttgtc

SEQ ID NO: 68662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaggccatagtctaccttt

SEQ ID NO: 68663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaggccatagtctacctt

SEQ ID NO: 68664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttcagaggccatagtcta

SEQ ID NO: 68665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtttcagaggccatagtct

SEQ ID NO: 68666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttagtttcagaggccatag

SEQ ID NO: 68667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttagtttcagaggccata

SEQ ID NO: 68668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccttagtttcagaggccat

SEQ ID NO: 68669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttccttagtttcagaggc

SEQ ID NO: 68670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctttccttagtttcagagg

SEQ ID NO: 68671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcctttccttagtttcaga

SEQ ID NO: 68672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaattcttcctttccttag

SEQ ID NO: 68673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaaaattcttcctttcctt

SEQ ID NO: 68674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctcaaaattcttcctttcc

SEQ ID NO: 68675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagtctctctcaaaattctt

SEQ ID NO: 68676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actacagtctctctcaaaat

SEQ ID NO: 68677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgactacagtctctctcaa

SEQ ID NO: 68678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atactgttgactacagtctc

SEQ ID NO: 68679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatactgttgactacagtct

SEQ ID NO: 68680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgatactgttgactacag

SEQ ID NO: 68681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaaaactgtttgatactgt

SEQ ID NO: 68682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcagaaaactgtttgatact

SEQ ID NO: 68683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actctcagaaaactgtttga

SEQ ID NO: 68684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actaactctcagaaaactgt

SEQ ID NO: 68685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcactaactctcagaaaac

SEQ ID NO: 68686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcaaaaatggaatctactc

SEQ ID NO: 68687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcaaaaatggaatctact

SEQ ID NO: 68688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatcaaaaatggaatctac

SEQ ID NO: 68689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaatcaaaaatggaatcta

SEQ ID NO: 68690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtccttttaatcaaaaatgg

SEQ ID NO: 68691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggtccttttaatcaaaaat

SEQ ID NO: 68692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tactctggtccttttaatca

SEQ ID NO: 68693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaaagagtctgtactctg

SEQ ID NO: 68694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagatcaatggaaccacca

SEQ ID NO: 68695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtattcccagatcaatggaa

SEQ ID NO: 68696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcgtattcccagatcaat

SEQ ID NO: 68697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattcgtattcccagatcaa

SEQ ID NO: 68698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagccttaattcgtattccc

SEQ ID NO: 68699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagccttaattcgtattcc

SEQ ID NO: 68700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagagccttaattcgtattc

SEQ ID NO: 68701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttagagccttaattcgta

SEQ ID NO: 68702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttagagccttaattcgt

SEQ ID NO: 68703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattttagagccttaattc

SEQ ID NO: 68704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttattttagagccttaatt

SEQ ID NO: 68705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttcttattttagagcctta

SEQ ID NO: 68706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctacttcttattttagagcc

SEQ ID NO: 68707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taagcatgctactacttctt

SEQ ID NO: 68708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gactgtaagcatgctactac

SEQ ID NO: 68709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatgttagactgtaagcatg

SEQ ID NO: 68710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcactgtatgttagactgta

SEQ ID NO: 68711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatcactgtatgttagact

SEQ ID NO: 68712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctatcactgtatgttagac

SEQ ID NO: 68713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acagtaatttcctatcactg

SEQ ID NO: 68714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actaacagtaatttcctatc

SEQ ID NO: 68715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gactaacagtaatttcctat

SEQ ID NO: 68716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggcacttgactaacagtaa

SEQ ID NO: 68717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacatctatggcacttgact

SEQ ID NO: 68718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacatctatggcacttgac

SEQ ID NO: 68719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtttccacatctatggcac

SEQ ID NO: 68720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtttccacatctatggca

SEQ ID NO: 68721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcttgagtttccacatcta

SEQ ID NO: 68722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagcttgagtttccacatc

SEQ ID NO: 68723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctaagcttgagtttccaca

SEQ ID NO: 68724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagctctctaagcttgagtt

SEQ ID NO: 68725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agggcaagtcactagagctc

SEQ ID NO: 68726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatgatgattaagggcaagt

SEQ ID NO: 68727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagctgtatgatgattaagg

SEQ ID NO: 68728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctatagctgtatgatgat

SEQ ID NO: 68729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attcagctatagctgtatga

SEQ ID NO: 68730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgctgattcagctatagc

SEQ ID NO: 68731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cattccatgctgattcagct

SEQ ID NO: 68732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcggtaagtcagaagactcc

SEQ ID NO: 68733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccagaggttgtcggtaagtc

SEQ ID NO: 68734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accagaggttgtcggtaagt

SEQ ID NO: 68735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atacttaccagaggttgtcg

SEQ ID NO: 68736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acgcctaatacttaccagag

SEQ ID NO: 68737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacgcctaatacttaccaga

SEQ ID NO: 68738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttaacgcctaatacttac

SEQ ID NO: 68739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttaacgcctaatactta

SEQ ID NO: 68740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggtttgtcttaacgcctaa

SEQ ID NO: 68741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggggtttgtcttaacgcct

SEQ ID NO: 68742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgttctggggtttgtctta

SEQ ID NO: 68743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attagtgttctggggtttgt

SEQ ID NO: 68744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattagtgttctggggtttg

SEQ ID NO: 68745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttaattagtgttctggggt

SEQ ID NO: 68746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcattccttaattagtgttc

SEQ ID NO: 68747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttagcattccttaattagt

SEQ ID NO: 68748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttagcattccttaattag

SEQ ID NO: 68749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaccttggttagcattcct

SEQ ID NO: 68750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagatggtaagacaaaaat

SEQ ID NO: 68751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacagatggtaagacaaaaa

SEQ ID NO: 68752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttcacagatggtaagacaa

SEQ ID NO: 68753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgatgagccagaggcctgtt

SEQ ID NO: 68754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaattccgatgagccagag

SEQ ID NO: 68755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacctatgaattccgatgag

SEQ ID NO: 68756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagaaggagaagaagcagag

SEQ ID NO: 68757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctggagaaggagaagaagc

SEQ ID NO: 68758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctggagaaggagaagaag

SEQ ID NO: 68759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcctggagaaggagaagaa

SEQ ID NO: 68760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataaccctttgcctggagaa

SEQ ID NO: 68761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagtgcagcacagttgata

SEQ ID NO: 68762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcagagtgcagcacagttg

SEQ ID NO: 68763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaccggtcaagctcctcaga

SEQ ID NO: 68764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagattaaaccggtcaagct

SEQ ID NO: 68765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagagattaaaccggtcaag

SEQ ID NO: 68766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagagattaaaccggtcaa

SEQ ID NO: 68767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctagagattaaaccggtca

SEQ ID NO: 68768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttctagagattaaaccgg

SEQ ID NO: 68769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtggggtggtgaattccttt

SEQ ID NO: 68770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctggtggggtggtgaattc

SEQ ID NO: 68771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgaactacctggtggggt

SEQ ID NO: 68772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaatgaactacctggtggg

SEQ ID NO: 68773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgaactctaaatgaacta

SEQ ID NO: 68774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatgaactctaaatgaact

SEQ ID NO: 68775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatcatatttgaatgaac

SEQ ID NO: 68776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatatcatatttgaatgaa

SEQ ID NO: 68777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataaggcttaaatatcata

SEQ ID NO: 68778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaataaggcttaaatatc

SEQ ID NO: 68779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attattaaataaggcttaaa

SEQ ID NO: 68780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgagtctgattattaaat

SEQ ID NO: 68781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatgagtctgattattaaa

SEQ ID NO: 68782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcatgagtctgattattaa

SEQ ID NO: 68783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataatactttgcatgagtct

SEQ ID NO: 68784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cataatactttgcatgagtc

SEQ ID NO: 68785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcataatactttgcatgagt

SEQ ID NO: 68786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcataatactttgcatgag

SEQ ID NO: 68787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcataatactttgcatga

SEQ ID NO: 68788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttcataatactttgcatg

SEQ ID NO: 68789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcttttttcataatacttt

SEQ ID NO: 68790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaatcttttttcataatac

SEQ ID NO: 68791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggccatcatactattaatc

SEQ ID NO: 68792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggccatcatactattaat

SEQ ID NO: 68793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatggccatcatactattaa

SEQ ID NO: 68794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatggccatcatactatta

SEQ ID NO: 68795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatggccatcatactatt

SEQ ID NO: 68796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacattttttatggccatca

SEQ ID NO: 68797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacattttttatggccatc

SEQ ID NO: 68798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatatgtgtttatacatttt

SEQ ID NO: 68799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acctcaatatgtgtttatac

SEQ ID NO: 68800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacctcaatatgtgtttata

SEQ ID NO: 68801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgacctcaatatgtgttt

SEQ ID NO: 68802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggttacttgacctcaatat

SEQ ID NO: 68803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggttacttgacctcaata

SEQ ID NO: 68804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggatggtgtagatagaaa

SEQ ID NO: 68805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaggatggtgtagatagaa

SEQ ID NO: 68806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaggatggtgtagataga

SEQ ID NO: 68807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttacaggatggtgtagat

SEQ ID NO: 68808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattttacaggatggtgta

SEQ ID NO: 68809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attattttacaggatggtgt

SEQ ID NO: 68810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtataataaacataataaag

SEQ ID NO: 68811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttagtataataaacataata

SEQ ID NO: 68812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttagtataataaacataat

SEQ ID NO: 68813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccacgtacttgttagtata

SEQ ID NO: 68814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggccacgtacttgttagtat

SEQ ID NO: 68815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggccacgtacttgttagta

SEQ ID NO: 68816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttggccacgtacttgtt

SEQ ID NO: 68817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctaattttggccacgtact

SEQ ID NO: 68818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctaattttggccacgtac

SEQ ID NO: 68819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttatctaattttggccac

SEQ ID NO: 68820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatcaatatattaccttat

SEQ ID NO: 68821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaagtgatagttaacatc

SEQ ID NO: 68822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaaagtgatagttaacat

SEQ ID NO: 68823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccaaaagtgatagttaaca

SEQ ID NO: 68824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaataagatgtggtcaat

SEQ ID NO: 68825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaataagatgtggtcaa

SEQ ID NO: 68826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatttaaaaaataagatg

SEQ ID NO: 68827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattaaaaatttaaaaaata

SEQ ID NO: 68828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattaaaaatttaaaaaat

SEQ ID NO: 68829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagtgtccataaatttata

SEQ ID NO: 68830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaataatgattgtcagtgtc

SEQ ID NO: 68831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcctcaaataatgattgtca

SEQ ID NO: 68832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaatagggtataggttgtc

SEQ ID NO: 68833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattgcaaatagggtatagg

SEQ ID NO: 68834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattatattgcaaatagggt

SEQ ID NO: 68835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtattatattgcaaataggg

SEQ ID NO: 68836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acacttgtattatattgcaa

SEQ ID NO: 68837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacacttgtattatattgca

SEQ ID NO: 68838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaatttgacacttgtatta

SEQ ID NO: 68839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgatcaggcattagtaat

SEQ ID NO: 68840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatgatcaggcattagtaa

SEQ ID NO: 68841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaatgatcaggcattagta

SEQ ID NO: 68842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agctttcaatgatcaggcat

SEQ ID NO: 68843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atctgagctttcaatgatca

SEQ ID NO: 68844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatctgagctttcaatgatc

SEQ ID NO: 68845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgatctgagctttcaatg

SEQ ID NO: 68846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaactatttgatctgagct

SEQ ID NO: 68847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccaactatttgatctgagc

SEQ ID NO: 68848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgccaactatttgatctgag

SEQ ID NO: 68849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgccaactatttgatctga

SEQ ID NO: 68850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgccaactatttgatctg

SEQ ID NO: 68851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaataagttttttgccaac

SEQ ID NO: 68852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actatcaataagttttttgc

SEQ ID NO: 68853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactatcaataagttttttg

SEQ ID NO: 68854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taactatcaataagtttttt

SEQ ID NO: 68855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaattttaactatcaata

SEQ ID NO: 68856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaattttaactatcaat

SEQ ID NO: 68857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaattttaactatcaa

SEQ ID NO: 68858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaaattttaactatca

SEQ ID NO: 68859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaaaaaattttaactatc

SEQ ID NO: 68860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttttaaaaaattttaac

SEQ ID NO: 68861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctttttaaaaaattttaa

SEQ ID NO: 68862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacttatctttttaaaaaat

SEQ ID NO: 68863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcacttatctttttaaaaaa

SEQ ID NO: 68864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttgcacttatctttttaa

SEQ ID NO: 68865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcttgcacttatcttttta

SEQ ID NO: 68866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatcttgcacttatcttttt

SEQ ID NO: 68867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gactttatcttgcacttatc

SEQ ID NO: 68868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggactttatcttgcacttat

SEQ ID NO: 68869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagagataataaaaaataca

SEQ ID NO: 68870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattcaagagataataaaaa

SEQ ID NO: 68871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattcaagagataataaaa

SEQ ID NO: 68872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catatatttaaattcaagag

SEQ ID NO: 68873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctacatatatttaaattcaa

SEQ ID NO: 68874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatcatcctgctacatatat

SEQ ID NO: 68875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctatatcatcctgctacat

SEQ ID NO: 68876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatctatatcatcctgctac

SEQ ID NO: 68877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatctatatcatcctgcta

SEQ ID NO: 68878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcaaagaacttctatctat

SEQ ID NO: 68879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatcaaagaacttctatcta

SEQ ID NO: 68880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggtcttgatcaaagaactt

SEQ ID NO: 68881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggtcttgatcaaagaact

SEQ ID NO: 68882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtggtcttgatcaaagaac

SEQ ID NO: 68883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttgtggtcttgatcaaa

SEQ ID NO: 68884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattttgtggtcttgatcaa

SEQ ID NO: 68885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaccgtatttgattttgt

SEQ ID NO: 68886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaaccgtatttgattttg

SEQ ID NO: 68887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttcaaaaccgtatttgat

SEQ ID NO: 68888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttcaaaaccgtatttga

SEQ ID NO: 68889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatttcaaaaccgtatttg

SEQ ID NO: 68890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcattttgatttcaaaaccg

SEQ ID NO: 68891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtatggtcattggcattttg

SEQ ID NO: 68892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatacaaaatgggtggtgtt

SEQ ID NO: 68893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatgttatatacaaaatgg

SEQ ID NO: 68894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatactaaaatgttatatac

SEQ ID NO: 68895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctatatactaaaatgttata

SEQ ID NO: 68896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactatatactaaaatgtta

SEQ ID NO: 68897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctactatatactaaaatgtt

SEQ ID NO: 68898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctactatatactaaaatgt

SEQ ID NO: 68899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctactatatactaaaatg

SEQ ID NO: 68900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcttttctactatatacta

SEQ ID NO: 68901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcttttctactatatact

SEQ ID NO: 68902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgatcttttctactatat

SEQ ID NO: 68903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaataatactgtttgatct

SEQ ID NO: 68904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acattataaataatactgtt

SEQ ID NO: 68905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacattataaataatactgt

SEQ ID NO: 68906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgacattataaataatact

SEQ ID NO: 68907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgacattataaataatac

SEQ ID NO: 68908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttgacattataaataata

SEQ ID NO: 68909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagccactttcttgacatt

SEQ ID NO: 68910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagccactttcttgacat

SEQ ID NO: 68911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtagccactttcttgaca

SEQ ID NO: 68912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttagtagccactttcttg

SEQ ID NO: 68913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actttagtagccactttctt

SEQ ID NO: 68914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgtggtgcttactttagt

SEQ ID NO: 68915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatgtggtgcttactttag

SEQ ID NO: 68916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagtttgcatgtggtgctt

SEQ ID NO: 68917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagagtttgcatgtggtgct

SEQ ID NO: 68918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcagagtttgcatgtggt

SEQ ID NO: 68919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttcagagtttgcatgtgg

SEQ ID NO: 68920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtttcagagtttgcatgtg

SEQ ID NO: 68921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gatctttgtttcagagtttg

SEQ ID NO: 68922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgatctttgtttcagagttt

SEQ ID NO: 68923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcgatctttgtttcagagt

SEQ ID NO: 68924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcgatctttgtttcagag

SEQ ID NO: 68925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttcgatctttgtttcaga

SEQ ID NO: 68926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttcttcgatctttgttt

SEQ ID NO: 68927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttcttcgatctttgtt

SEQ ID NO: 68928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccatgtttaattttcttcga

SEQ ID NO: 68929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgtgtaagtctgccatgt

SEQ ID NO: 68930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttccatgtgtaagtctgcca

SEQ ID NO: 68931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attattccatgtgtaagtct

SEQ ID NO: 68932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgatcataatgacaatga

SEQ ID NO: 68933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatgatcataatgacaatg

SEQ ID NO: 68934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatcacttatatgatcata

SEQ ID NO: 68935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cgttatgatcacttatatga

SEQ ID NO: 68936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcgttatgatcacttatatg

SEQ ID NO: 68937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgcgttatgatcacttat

SEQ ID NO: 68938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtgagaaaaacctatttgc

SEQ ID NO: 68939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgggtgagaaaaacctattt

SEQ ID NO: 68940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataaagctctgggtgagaaa

SEQ ID NO: 68941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcataaagctctgggtgag

SEQ ID NO: 68942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtgtgtgtgtgtgtatgtgt

SEQ ID NO: 68943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgtgtgtgtgtgtgtatgtg

SEQ ID NO: 68944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcgtgtgtgtgtgtgtatg

SEQ ID NO: 68945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcgtgtgtgtgtgtgtat

SEQ ID NO: 68946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaagatttcttcgtgtgtg

SEQ ID NO: 68947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaagatttcttcgtgtgt

SEQ ID NO: 68948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaaagatttcttcgtgtg

SEQ ID NO: 68949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtaaagatttcttcgtgt

SEQ ID NO: 68950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtaaagatttcttcgtg

SEQ ID NO: 68951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatgtattttttgtaaagat

SEQ ID NO: 68952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtatgtattttttgtaaa

SEQ ID NO: 68953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagttgctgtatgtattttt

SEQ ID NO: 68954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctacagttgctgtatgtatt

SEQ ID NO: 68955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctacagttgctgtatgtat

SEQ ID NO: 68956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctacagttgctgtatgta

SEQ ID NO: 68957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagagttttgctacagttg

SEQ ID NO: 68958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacagagttttgctacagtt

SEQ ID NO: 68959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaaatttgacagagttttg

SEQ ID NO: 68960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaaatttgacagagtttt

SEQ ID NO: 68961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaacaatatttgggaaat

SEQ ID NO: 68962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaaacaatatttgggaaa

SEQ ID NO: 68963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tataaaacaatatttgggaa

SEQ ID NO: 68964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctttataaaacaatatttgg

SEQ ID NO: 68965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcctttataaaacaatatt

SEQ ID NO: 68966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcctttataaaacaatat

SEQ ID NO: 68967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactcctttataaaacaata

SEQ ID NO: 68968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttactcctttataaaaca

SEQ ID NO: 68969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatgctgctttactccttt

SEQ ID NO: 68970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattgatatgctgctttact

SEQ ID NO: 68971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccattgatatgctgctttac

SEQ ID NO: 68972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttccattgatatgctgcttt

SEQ ID NO: 68973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actcttccattgatatgctg

SEQ ID NO: 68974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaaatgagaatgaaaaatt

SEQ ID NO: 68975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcaaatgagaatgaaaaat

SEQ ID NO: 68976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatgtcatttagcaaatga

SEQ ID NO: 68977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatattcacatgtcatttag

SEQ ID NO: 68978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatattcacatgtcattta

SEQ ID NO: 68979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaatattcacatgtcattt

SEQ ID NO: 68980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtagctttcaatattcacat

SEQ ID NO: 68981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtaactagtagctttcaa

SEQ ID NO: 68982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttgtagtaactagtagct

SEQ ID NO: 68983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataagagaattgtgttgtag

SEQ ID NO: 68984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aataagagaattgtgttgta

SEQ ID NO: 68985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taacttaataagagaattgt

SEQ ID NO: 68986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaaagataaagttgtaact

SEQ ID NO: 68987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaaaaagataaagttgtaa

SEQ ID NO: 68988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctctaaaaaagataaagttg

SEQ ID NO: 68989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactactctaaaaaagataa

SEQ ID NO: 68990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaactactctaaaaaagata

SEQ ID NO: 68991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgaactactctaaaaaag

SEQ ID NO: 68992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcttgaactactctaaaaaa

SEQ ID NO: 68993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacttgcttgaactactcta

SEQ ID NO: 68994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcacttgcttgaactactct

SEQ ID NO: 68995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcacttgcacttgcttgaac

SEQ ID NO: 68996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcacttgcacttgcttgaa

SEQ ID NO: 68997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagcacttgcacttgcttga

SEQ ID NO: 68998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagcacttgcacttgcttg

SEQ ID NO: 68999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttagcacttgcacttgc

SEQ ID NO: 69000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatttttagcacttgcact

SEQ ID NO: 69001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatttttagcacttgcac

SEQ ID NO: 69002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattatttttagcacttgca

SEQ ID NO: 69003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaataagtattttattattt

SEQ ID NO: 69004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgaaataagtattttatt

SEQ ID NO: 69005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctgaaataagtattttat

SEQ ID NO: 69006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaatcaatttatctgaaat

SEQ ID NO: 69007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagattgagaatcaattta

SEQ ID NO: 69008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atacaaattcatagattgag

SEQ ID NO: 69009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcatattaatacaaattcat

SEQ ID NO: 69010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggctatcatattaatacaaa

SEQ ID NO: 69011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gattgggctatcatattaat

SEQ ID NO: 69012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agattgggctatcatattaa

SEQ ID NO: 69013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagattgggctatcatatta

SEQ ID NO: 69014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagtcaaacctttagattg

SEQ ID NO: 69015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaaagtcaaacctttagat

SEQ ID NO: 69016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagtcaatctctaaaagtc

SEQ ID NO: 69017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaagtcaatctctaaaagt

SEQ ID NO: 69018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcttccaagtcaatctctaa

SEQ ID NO: 69019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagcttccaagtcaatctct

SEQ ID NO: 69020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctagcttccaagtcaatctc

SEQ ID NO: 69021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtggtacccatcaagaat

SEQ ID NO: 69022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgtggtacccatcaagaa

SEQ ID NO: 69023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaatttaatgtggtaccca

SEQ ID NO: 69024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtgataataatagcattga

SEQ ID NO: 69025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatactaggtgataataata

SEQ ID NO: 69026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatgttgtatactaggtga

SEQ ID NO: 69027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgatgttgtatactaggtg

SEQ ID NO: 69028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgatgttgtatactaggt

SEQ ID NO: 69029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatgatgttgtatactagg

SEQ ID NO: 69030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccatgccatttttatgatg

SEQ ID NO: 69031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccatgccatttttatgat

SEQ ID NO: 69032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatccatgccatttttatga

SEQ ID NO: 69033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtacaatactttatccatg

SEQ ID NO: 69034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgtacaatactttatccat

SEQ ID NO: 69035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttatgtacaatactttatc

SEQ ID NO: 69036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catcattccttatgtacaat

SEQ ID NO: 69037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatcattccttatgtacaa

SEQ ID NO: 69038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttacatcattccttatgta

SEQ ID NO: 69039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgcttacatcattcctta

SEQ ID NO: 69040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagaaagacattgtctgct

SEQ ID NO: 69041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagttataagaaagacattg

SEQ ID NO: 69042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctccagttataagaaagaca

SEQ ID NO: 69043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actccagttataagaaagac

SEQ ID NO: 69044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttactccagttataagaaa

SEQ ID NO: 69045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataattatttactccagtta

SEQ ID NO: 69046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcataattatttactccag

SEQ ID NO: 69047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataggttgttcataattatt

SEQ ID NO: 69048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aataggttgttcataattat

SEQ ID NO: 69049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaataggttgttcataatt

SEQ ID NO: 69050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttaataggttgttcataa

SEQ ID NO: 69051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaggagttctcttaataggt

SEQ ID NO: 69052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggccaacatagattggagga

SEQ ID NO: 69053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taggccaacatagattggag

SEQ ID NO: 69054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgggaataatgcctctagg

SEQ ID NO: 69055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacctggtgggaataatgcc

SEQ ID NO: 69056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctggacctggtgggaataat

SEQ ID NO: 69057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaactcctggacctggtg

SEQ ID NO: 69058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatcaaactcctggacctg

SEQ ID NO: 69059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaactgttatcaaactcctg

SEQ ID NO: 69060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataactgaaactgttatcaa

SEQ ID NO: 69061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cataactgaaactgttatca

SEQ ID NO: 69062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcataactgaaactgttatc

SEQ ID NO: 69063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atactttcataactgaaact

SEQ ID NO: 69064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactgatactttcataactg

SEQ ID NO: 69065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtactgatactttcataact

SEQ ID NO: 69066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtactgatactttcataac

SEQ ID NO: 69067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtgaaattttgtactgata

SEQ ID NO: 69068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtgaaattttgtactgat

SEQ ID NO: 69069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagtgaaattttgtactga

SEQ ID NO: 69070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagtgaaattttgtactg

SEQ ID NO: 69071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataacatgtttttgagtga

SEQ ID NO: 69072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaataacatgtttttgagtg

SEQ ID NO: 69073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatcagtttaaataacatgt

SEQ ID NO: 69074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatgaattcaatcagtttaa

SEQ ID NO: 69075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatgaattcaatcagttta

SEQ ID NO: 69076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttagatgaattcaatcag

SEQ ID NO: 69077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactaatttagatgaattca

SEQ ID NO: 69078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaaactaatttagatga

SEQ ID NO: 69079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattaaactaatttagatg

SEQ ID NO: 69080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaattaaactaatttagat

SEQ ID NO: 69081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaaattaaactaattta

SEQ ID NO: 69082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttaaattaaactaattt

SEQ ID NO: 69083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttattttaaattaaacta

SEQ ID NO: 69084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatcttattttaaattaaa

SEQ ID NO: 69085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattatcttattttaaatta

SEQ ID NO: 69086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattatcttattttaaatt

SEQ ID NO: 69087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttctattatcttatttta

SEQ ID NO: 69088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattaatttctattatctt

SEQ ID NO: 69089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttataattaatttctatt

SEQ ID NO: 69090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagaatattcagttataatt

SEQ ID NO: 69091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagaatattcagttataat

SEQ ID NO: 69092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatagaatattcagttataa

SEQ ID NO: 69093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagttttatagaatattcag

SEQ ID NO: 69094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatagttttatagaatattc

SEQ ID NO: 69095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctatagttttatagaata

SEQ ID NO: 69096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagcctattctatagtttta

SEQ ID NO: 69097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagcctattctatagtttt

SEQ ID NO: 69098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaagcctattctatagttt

SEQ ID NO: 69099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactttaaagcctattctat

SEQ ID NO: 69100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atactttaaagcctattcta

SEQ ID NO: 69101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagtttatactttaaagcct

SEQ ID NO: 69102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatagtttatactttaaagc

SEQ ID NO: 69103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attctatagtttatacttta

SEQ ID NO: 69104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaactcattctatagtttat

SEQ ID NO: 69105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaactcattctatagttta

SEQ ID NO: 69106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaactcattctatagttt

SEQ ID NO: 69107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatattttaaaactcattct

SEQ ID NO: 69108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatattttaaaactcattc

SEQ ID NO: 69109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacttatatattttaaaac

SEQ ID NO: 69110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacttatatattttaaaa

SEQ ID NO: 69111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaacttatatattttaaa

SEQ ID NO: 69112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattttaaaacttatatatt

SEQ ID NO: 69113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctgtattttaaaacttat

SEQ ID NO: 69114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gattaatctgtattttaaaa

SEQ ID NO: 69115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggattaatctgtatttta

SEQ ID NO: 69116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctggattaatctgtatttt

SEQ ID NO: 69117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccaacatcgtttcctggat

SEQ ID NO: 69118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccaacatcgtttcctgga

SEQ ID NO: 69119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagtttatccaacatcgtt

SEQ ID NO: 69120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaattataagtttatccaa

SEQ ID NO: 69121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcacaaaatacatattagta

SEQ ID NO: 69122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggcaattggcacaaaatac

SEQ ID NO: 69123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggcaattggcacaaaata

SEQ ID NO: 69124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtggcaattggcacaaaat

SEQ ID NO: 69125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattttgtggcaattggcac

SEQ ID NO: 69126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggattttgtggcaattggca

SEQ ID NO: 69127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggattttgtggcaattggc

SEQ ID NO: 69128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatatggtactttggatttt

SEQ ID NO: 69129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaatatggtactttggatt

SEQ ID NO: 69130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaaatatggtactttggat

SEQ ID NO: 69131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagtcttctaaatatggtac

SEQ ID NO: 69132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaactgtagtcttctaaata

SEQ ID NO: 69133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagccattaaaactgtagtc

SEQ ID NO: 69134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acgtgcagccgagaggtcag

SEQ ID NO: 69135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgatagttcacgtgcagcc

SEQ ID NO: 69136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggtgatagttcacgtgcag

SEQ ID NO: 69137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctggtgatagttcacgtgc

SEQ ID NO: 69138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctggtgatagttcacgtg

SEQ ID NO: 69139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttctctggtgatagttca

SEQ ID NO: 69140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacttctctggtgatagttc

SEQ ID NO: 69141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcacttctctggtgatagtt

SEQ ID NO: 69142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctttcacttctctggtgat

SEQ ID NO: 69143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtctttcacttctctggtga

SEQ ID NO: 69144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagaataatagggccttgt

SEQ ID NO: 69145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacagaataatagggccttg

SEQ ID NO: 69146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttcacagaataatagggc

SEQ ID NO: 69147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacttcacagaataataggg

SEQ ID NO: 69148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcttaacttcacagaataa

SEQ ID NO: 69149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaatgaagggcctggtct

SEQ ID NO: 69150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaaatgaagggcctggtc

SEQ ID NO: 69151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagaaatgaagggcctggt

SEQ ID NO: 69152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcagaaatgaagggcctgg

SEQ ID NO: 69153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcagaaatgaagggcctg

SEQ ID NO: 69154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttcagaaatgaagggcct

SEQ ID NO: 69155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttcagaaatgaagggc

SEQ ID NO: 69156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaacccaggccaataattc

SEQ ID NO: 69157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctcaaaacccaggccaata

SEQ ID NO: 69158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctcaaaacccaggccaat

SEQ ID NO: 69159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacctcaaaacccaggccaa

SEQ ID NO: 69160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttacctcaaaacccaggc

SEQ ID NO: 69161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgctttacctcaaaaccc

SEQ ID NO: 69162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcactgctttacctcaaaac

SEQ ID NO: 69163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctcactgctttacctcaa

SEQ ID NO: 69164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcagcaattcctctcactgc

SEQ ID NO: 69165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatcagcaattcctctcact

SEQ ID NO: 69166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatcagcaattcctctcac

SEQ ID NO: 69167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctatcagcaattcctctca

SEQ ID NO: 69168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctatcagcaattcctct

SEQ ID NO: 69169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattctttctatcagcaatt

SEQ ID NO: 69170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattctttctatcagcaat

SEQ ID NO: 69171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtattctttctatcagcaa

SEQ ID NO: 69172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atagcaggggggtgctttgt

SEQ ID NO: 69173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtctaatagcaggggggtg

SEQ ID NO: 69174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atattgtgtctaatagcagg

SEQ ID NO: 69175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaatattgtgtctaatagc

SEQ ID NO: 69176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgttaatattgtgtctaat

SEQ ID NO: 69177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattgttaatattgtgtct

SEQ ID NO: 69178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctattgttaatattgtgtc

SEQ ID NO: 69179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcctattgttaatattgt

SEQ ID NO: 69180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taactatttcctattgttaa

SEQ ID NO: 69181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagaaaaaccattataact

SEQ ID NO: 69182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccagctcagagaaaaaccat

SEQ ID NO: 69183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaccagctcagagaaaaac

SEQ ID NO: 69184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagttgttaccagctcaga

SEQ ID NO: 69185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagttgttaccagctcag

SEQ ID NO: 69186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaaaagttgttaccagct

SEQ ID NO: 69187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttaaaagttgttaccagc

SEQ ID NO: 69188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttaaaagttgttaccag

SEQ ID NO: 69189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaataagaatcattttatt

SEQ ID NO: 69190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcaaataagaatcatttta

SEQ ID NO: 69191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagtcagaattctgcaaata

SEQ ID NO: 69192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctaaagtcagaattctgca

SEQ ID NO: 69193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctaaagtcagaattctgc

SEQ ID NO: 69194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaatttagctaaagtcag

SEQ ID NO: 69195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgaatttagctaaagtca

SEQ ID NO: 69196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatgaatttagctaaagtc

SEQ ID NO: 69197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagatgctttcatgaattta

SEQ ID NO: 69198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagatgctttcatgaattt

SEQ ID NO: 69199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtttgaagatgctttcat

SEQ ID NO: 69200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgatgtttgaagatgcttt

SEQ ID NO: 69201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacagtgagaaaaccaatta

SEQ ID NO: 69202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaacagtgagaaaaccaatt

SEQ ID NO: 69203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaaacagtgagaaaaccaa

SEQ ID NO: 69204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttaaacagtgagaaaacc

SEQ ID NO: 69205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgctctcttaaacagtgag

SEQ ID NO: 69206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaatgctctcttaaacagt

SEQ ID NO: 69207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaatgctctcttaaacag

SEQ ID NO: 69208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttaatgctctcttaaaca

SEQ ID NO: 69209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcataaatctttgttaatgc

SEQ ID NO: 69210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcataaatctttgttaatg

SEQ ID NO: 69211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttggcataaatctttgtt

SEQ ID NO: 69212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataatctaatttggcataaa

SEQ ID NO: 69213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcataatctaatttggcat

SEQ ID NO: 69214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctcataatctaatttggca

SEQ ID NO: 69215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgctcataatctaatttg

SEQ ID NO: 69216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttgctcataatctaattt

SEQ ID NO: 69217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacttgctcataatctaatt

SEQ ID NO: 69218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacttgctcataatctaat

SEQ ID NO: 69219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataaaatcacgtgaatttt

SEQ ID NO: 69220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacaacaagatacactatat

SEQ ID NO: 69221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacaacaagatacactata

SEQ ID NO: 69222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catatgaaaaaaagtttcaa

SEQ ID NO: 69223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaacataaaacctgcat

SEQ ID NO: 69224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accattaaaaaaacataaaa

SEQ ID NO: 69225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattgaccattaaaaaaaca

SEQ ID NO: 69226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattcaattgaccattaaaa

SEQ ID NO: 69227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgccaagctgaattcaattg

SEQ ID NO: 69228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgccaagctgaattcaat

SEQ ID NO: 69229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatgtaaaattctgtgcca

SEQ ID NO: 69230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgatgtaaaattctgtgcc

SEQ ID NO: 69231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgatgtaaaattctgtgc

SEQ ID NO: 69232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aataactttatgatgtaaaa

SEQ ID NO: 69233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacaataatattgaataact

SEQ ID NO: 69234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcccattgaacaataatatt

SEQ ID NO: 69235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtcccattgaacaataata

SEQ ID NO: 69236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtcccattgaacaataat

SEQ ID NO: 69237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataatttctgtcccattgaa

SEQ ID NO: 69238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gataatttctgtcccattga

SEQ ID NO: 69239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgataatttctgtcccattg

SEQ ID NO: 69240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatattttgataatttctgt

SEQ ID NO: 69241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgttaaatattttgataat

SEQ ID NO: 69242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatagttcatgttaaata

SEQ ID NO: 69243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaataatagttcatgtta

SEQ ID NO: 69244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaatacaaattaattaata

SEQ ID NO: 69245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgtaaatacaaattaatt

SEQ ID NO: 69246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctgtaaatacaaattaat

SEQ ID NO: 69247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccataataatttgtctgta

SEQ ID NO: 69248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttagccataataatttgtct

SEQ ID NO: 69249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaatctattagccataata

SEQ ID NO: 69250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgtctaagaatctattag

SEQ ID NO: 69251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaagaaaacattgaatgtc

SEQ ID NO: 69252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgcattcccaagaaaacat

SEQ ID NO: 69253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatgcattcccaagaaaaca

SEQ ID NO: 69254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatacttaatgcattcccaa

SEQ ID NO: 69255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatacttaatgcattccca

SEQ ID NO: 69256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgaatacttaatgcattc

SEQ ID NO: 69257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtttgaatacttaatgca

SEQ ID NO: 69258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatacagtatggaaatagtt

SEQ ID NO: 69259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatacagtatggaaatagt

SEQ ID NO: 69260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatacagtatggaaatag

SEQ ID NO: 69261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttatatacagtatggaa

SEQ ID NO: 69262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttatatacagtatgga

SEQ ID NO: 69263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaacatttaattttatata

SEQ ID NO: 69264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataaacatttaattttatat

SEQ ID NO: 69265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagcatgcttataaacattt

SEQ ID NO: 69266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaagcatgcttataaaca

SEQ ID NO: 69267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattgctaaagcatgcttat

SEQ ID NO: 69268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctatattgctaaagcatgc

SEQ ID NO: 69269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaactgtctatattgctaaa

SEQ ID NO: 69270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actagaactgtctatattgc

SEQ ID NO: 69271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattgactagaactgtctat

SEQ ID NO: 69272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaggctgaattgactagaa

SEQ ID NO: 69273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaggctgaattgactaga

SEQ ID NO: 69274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagcaagtatagatttcaaa

SEQ ID NO: 69275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactgtagcaagtatagatt

SEQ ID NO: 69276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atactgtagcaagtatagat

SEQ ID NO: 69277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagaagcttatactgtagca

SEQ ID NO: 69278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctaaagaagcttatactgta

SEQ ID NO: 69279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaatctgctaaagaagctt

SEQ ID NO: 69280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaaatctgctaaagaagct

SEQ ID NO: 69281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttagaaatctgctaaagaag

SEQ ID NO: 69282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttagaaatctgctaaaga

SEQ ID NO: 69283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataaaggtattctcttaga

SEQ ID NO: 69284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatataaaggtattctctta

SEQ ID NO: 69285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatataaaggtattctctt

SEQ ID NO: 69286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctatataaaggtattctct

SEQ ID NO: 69287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatatcagcctttctata

SEQ ID NO: 69288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatatatatcagcctttct

SEQ ID NO: 69289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatatatatcagcctttc

SEQ ID NO: 69290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattatatatatcagccttt

SEQ ID NO: 69291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accgcaggaaaaaaaaactt

SEQ ID NO: 69292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccgcaggaaaaaaaaact

SEQ ID NO: 69293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatatatttcaccgcaggaa

SEQ ID NO: 69294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgagaattcaatatatttca

SEQ ID NO: 69295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgtgagaattcaatatatt

SEQ ID NO: 69296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatggtgatgcctactgt

SEQ ID NO: 69297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatatggtgatgcctactg

SEQ ID NO: 69298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagtacttaaatatggtga

SEQ ID NO: 69299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatagtaaaaaacatatatt

SEQ ID NO: 69300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtatagtaaaaaacatatat

SEQ ID NO: 69301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgtatagtaaaaaacata

SEQ ID NO: 69302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttgtatagtaaaaaacat

SEQ ID NO: 69303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatgatcttccttgtatag

SEQ ID NO: 69304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcatataaaataatacaaa

SEQ ID NO: 69305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaaatgaagataatatag

SEQ ID NO: 69306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagaaatgaagataatata

SEQ ID NO: 69307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtttaaagaaatgaagata

SEQ ID NO: 69308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacaacagatgattgagttt

SEQ ID NO: 69309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catggaaaactaaacaacag

SEQ ID NO: 69310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaattacatggaaaacta

SEQ ID NO: 69311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaaattacatggaaaact

SEQ ID NO: 69312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttccaaaattacatggaa

SEQ ID NO: 69313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttccaaaattacatgga

SEQ ID NO: 69314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatttccaaaattacatgg

SEQ ID NO: 69315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcatttccaaaattacat

SEQ ID NO: 69316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatagtcattctttcattt

SEQ ID NO: 69317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatatagtcattctttcat

SEQ ID NO: 69318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaatatagtcattctttc

SEQ ID NO: 69319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctaatatagtcattcttt

SEQ ID NO: 69320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttctctaatatagtcatt

SEQ ID NO: 69321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacttctctaatatagtcat

SEQ ID NO: 69322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcacttctctaatatagt

SEQ ID NO: 69323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcacttctctaatatag

SEQ ID NO: 69324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagcatttatttcacttctc

SEQ ID NO: 69325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atactaaagcatttatttca

SEQ ID NO: 69326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catactaaagcatttatttc

SEQ ID NO: 69327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatactaaagcatttattt

SEQ ID NO: 69328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcatactaaagcatttat

SEQ ID NO: 69329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcatactaaagcattta

SEQ ID NO: 69330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatagcaaaagaaatttct

SEQ ID NO: 69331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatagcaaaagaaatttc

SEQ ID NO: 69332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttataatagcaaaagaaat

SEQ ID NO: 69333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagaaggtcctatttataat

SEQ ID NO: 69334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaatcaaatccatgtgaaa

SEQ ID NO: 69335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagaaatcaaatccatgtg

SEQ ID NO: 69336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attagaaatcaaatccatgt

SEQ ID NO: 69337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattagaaatcaaatccatg

SEQ ID NO: 69338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattagaaatcaaatccat

SEQ ID NO: 69339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttttattagaaatcaaat

SEQ ID NO: 69340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccttttattagaaatcaaa

SEQ ID NO: 69341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atacttcccttttattagaa

SEQ ID NO: 69342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaatgatgaaaaaaattga

SEQ ID NO: 69343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gactgccaatgatgaaaaaa

SEQ ID NO: 69344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taactagactgccaatgatg

SEQ ID NO: 69345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataactagactgccaatgat

SEQ ID NO: 69346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttataactagactgccaat

SEQ ID NO: 69347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttataactagactgccaa

SEQ ID NO: 69348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttataactagactgcca

SEQ ID NO: 69349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttatttataactagactg

SEQ ID NO: 69350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actttatttataactagact

SEQ ID NO: 69351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttactttatttataact

SEQ ID NO: 69352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttactttatttataac

SEQ ID NO: 69353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttatatttactttattt

SEQ ID NO: 69354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatttatatttactttatt

SEQ ID NO: 69355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcttatatttatatttact

SEQ ID NO: 69356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcctatgcttatatttata

SEQ ID NO: 69357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatcctatgcttatatttat

SEQ ID NO: 69358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgatcctatgcttatattt

SEQ ID NO: 69359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgatcctatgcttatatt

SEQ ID NO: 69360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgagtccaccttcttgatc

SEQ ID NO: 69361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atactagtgagtccaccttc

SEQ ID NO: 69362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaatactagtgagtccacc

SEQ ID NO: 69363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attcctaatactagtgagtc

SEQ ID NO: 69364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgattcctaatactagtgag

SEQ ID NO: 69365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgattcctaatactagtga

SEQ ID NO: 69366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtacacttctgattccta

SEQ ID NO: 69367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attatggtacacttctgatt

SEQ ID NO: 69368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aataaaaaggcaggaatgct

SEQ ID NO: 69369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaataaaaaggcaggaat

SEQ ID NO: 69370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaggcacagtcaatatcat

SEQ ID NO: 69371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaggcacagtcaatatca

SEQ ID NO: 69372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaaggcacagtcaatatc

SEQ ID NO: 69373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagaaggcacagtcaatat

SEQ ID NO: 69374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacacttttagaaggcaca

SEQ ID NO: 69375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacacttttagaaggcac

SEQ ID NO: 69376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaacacttttagaaggca

SEQ ID NO: 69377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaacacttttagaaggc

SEQ ID NO: 69378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatttttaaaacactttta

SEQ ID NO: 69379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatttttaaaacactttt

SEQ ID NO: 69380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatatttttaaaacacttt

SEQ ID NO: 69381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatcactttcatatttttaa

SEQ ID NO: 69382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtcaactatatcactttca

SEQ ID NO: 69383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtcaactatatcactttc

SEQ ID NO: 69384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgtttgagtcaactata

SEQ ID NO: 69385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatgtttgagtcaactat

SEQ ID NO: 69386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacatttaaaatgtttgagt

SEQ ID NO: 69387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatacatttaaaatgtttg

SEQ ID NO: 69388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaatactattatacattta

SEQ ID NO: 69389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cactgtaaatactattatac

SEQ ID NO: 69390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcactgtaaatactattata

SEQ ID NO: 69391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcactgtaaatactattat

SEQ ID NO: 69392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgcactgtaaatactat

SEQ ID NO: 69393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttgcactgtaaatacta

SEQ ID NO: 69394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttgcactgtaaatact

SEQ ID NO: 69395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattttgcactgtaaatac

SEQ ID NO: 69396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatcaaggagatagtggagg

SEQ ID NO: 69397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagggggttgaatcaaggag

SEQ ID NO: 69398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctcaagggggttgaatcaa

SEQ ID NO: 69399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gattacctcaagggggttga

SEQ ID NO: 69400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcgattacctcaagggggtt

SEQ ID NO: 69401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctcgattacctcaaggggg

SEQ ID NO: 69402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctcgattacctcaaggg

SEQ ID NO: 69403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctctctcgattacctcaag

SEQ ID NO: 69404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctctctcgattacctcaa

SEQ ID NO: 69405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctctctcgattacctca

SEQ ID NO: 69406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctctctctcgattacctc

SEQ ID NO: 69407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctctctctcgattacct

SEQ ID NO: 69408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttttctctctctcgattac

SEQ ID NO: 69409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctttttctctctctcgatt

SEQ ID NO: 69410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctttttctctctctcga

SEQ ID NO: 69411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctttttctctctctc

SEQ ID NO: 69412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctctctctttttctctct

SEQ ID NO: 69413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcctctctctctttttctct

SEQ ID NO: 69414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctcctctctctctttttct

SEQ ID NO: 69415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctcctctctctcttttt

SEQ ID NO: 69416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctcctctctctcttt

SEQ ID NO: 69417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctctcctctctctct

SEQ ID NO: 69418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctctctcctctctct

SEQ ID NO: 69419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctctctctcctctct

SEQ ID NO: 69420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctctctctctcctct

SEQ ID NO: 69421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctctctctctctcct

SEQ ID NO: 69422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctctctctctctctc

SEQ ID NO: 69423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctctctctctctctc

SEQ ID NO: 69424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaaatatggaaagatatgt

SEQ ID NO: 69425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatggatgcacactgaaaaa

SEQ ID NO: 69426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagtgttgtatggatgcaca

SEQ ID NO: 69427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagctatagtgttgtatgg

SEQ ID NO: 69428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacagctatagtgttgtatg

SEQ ID NO: 69429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcacagctatagtgttgt

SEQ ID NO: 69430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatcaagataaggattgtt

SEQ ID NO: 69431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaatcaagataaggattgt

SEQ ID NO: 69432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cataagtttacaatcaagat

SEQ ID NO: 69433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatagctacataagtttaca

SEQ ID NO: 69434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatagctacataagtttac

SEQ ID NO: 69435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaggagcatcttaaatag

SEQ ID NO: 69436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtaattgaaaaggagcatc

SEQ ID NO: 69437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtaattgaaaaggagcat

SEQ ID NO: 69438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtaattgaaaaggagca

SEQ ID NO: 69439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacatattttcagtaattga

SEQ ID NO: 69440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggacatattttcagtaattg

SEQ ID NO: 69441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttggacatattttcagta

SEQ ID NO: 69442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttggacatattttcagt

SEQ ID NO: 69443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatttggacatattttcag

SEQ ID NO: 69444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaatttggacatattttca

SEQ ID NO: 69445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggcaatcaaagggaaaac

SEQ ID NO: 69446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaggcaatcaaagggaaaa

SEQ ID NO: 69447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagcagtatagtagaaaaca

SEQ ID NO: 69448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcaagcagtatagtagaaa

SEQ ID NO: 69449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactcaagcagtatagtaga

SEQ ID NO: 69450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctactcaagcagtatagtag

SEQ ID NO: 69451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acacaatttctactcaagca

SEQ ID NO: 69452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacacaatttctactcaagc

SEQ ID NO: 69453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatgatacatatatttaac

SEQ ID NO: 69454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatatgatacatatattta

SEQ ID NO: 69455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggacatgttctaatatgata

SEQ ID NO: 69456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggacatgttctaatatgat

SEQ ID NO: 69457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagtgaacaacttaggaca

SEQ ID NO: 69458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaagtgaacaacttaggac

SEQ ID NO: 69459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaaatgccagtgataaatt

SEQ ID NO: 69460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggaaatgccagtgataaat

SEQ ID NO: 69461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttaggaaatgccagtgat

SEQ ID NO: 69462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcttaggaaatgccagtga

SEQ ID NO: 69463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtttatcttaggaaatgc

SEQ ID NO: 69464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catcgttaatgtttatctta

SEQ ID NO: 69465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatcgttaatgtttatctt

SEQ ID NO: 69466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accatcatccatgatagcat

SEQ ID NO: 69467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcattaaccatcatccatga

SEQ ID NO: 69468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaacaataaataactagcat

SEQ ID NO: 69469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaacaataaataactagca

SEQ ID NO: 69470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttggaacaataaataactag

SEQ ID NO: 69471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acacctcttggaacaataaa

SEQ ID NO: 69472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctcacacctcttggaacaa

SEQ ID NO: 69473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctacctcacacctcttggaa

SEQ ID NO: 69474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacactcctacctcacacct

SEQ ID NO: 69475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaagtcattagacactcct

SEQ ID NO: 69476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gattatcaagtcattagaca

SEQ ID NO: 69477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcgttagattatcaagtca

SEQ ID NO: 69478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagcgttagattatcaagtc

SEQ ID NO: 69479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagcgttagattatcaagt

SEQ ID NO: 69480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgagcgttagattatcaag

SEQ ID NO: 69481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgagcgttagattatca

SEQ ID NO: 69482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttgagcgttagattatc

SEQ ID NO: 69483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttttgagcgttagatta

SEQ ID NO: 69484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcttttgagcgttagatt

SEQ ID NO: 69485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagtttcttcttttgagcg

SEQ ID NO: 69486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatagtttcttcttttgagc

SEQ ID NO: 69487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtttgatagtttcttcttt

SEQ ID NO: 69488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgtgtttgatagtttcttc

SEQ ID NO: 69489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacagtgctgctgtgtttga

SEQ ID NO: 69490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacagtgctgctgtgtttg

SEQ ID NO: 69491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtacagtgctgctgtgttt

SEQ ID NO: 69492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttttgtacagtgctgctg

SEQ ID NO: 69493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgttttgtacagtgctgc

SEQ ID NO: 69494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttctgtgttttgtacagt

SEQ ID NO: 69495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgagttctgtgttttgtac

SEQ ID NO: 69496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgagttctgtgttttgta

SEQ ID NO: 69497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgagttctgtgttttgt

SEQ ID NO: 69498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttgagttctgtgttttg

SEQ ID NO: 69499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtaaggtttttgttgagtt

SEQ ID NO: 69500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtaaggtttttgttgagt

SEQ ID NO: 69501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagtaaggtttttgttgag

SEQ ID NO: 69502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgagtaaggtttttgttg

SEQ ID NO: 69503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttgagtaaggtttttgt

SEQ ID NO: 69504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcatcaatcattctctttg

SEQ ID NO: 69505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcatcaatcattctcttt

SEQ ID NO: 69506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagcatcaatcattctctt

SEQ ID NO: 69507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcagcatcaatcattctct

SEQ ID NO: 69508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttcagcatcaatcattct

SEQ ID NO: 69509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttcttttcagcatcaatc

SEQ ID NO: 69510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagttcttttcagcatcaat

SEQ ID NO: 69511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagttcttttcagcatcaa

SEQ ID NO: 69512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcagttcttttcagcatca

SEQ ID NO: 69513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatgtaacatttttcagtt

SEQ ID NO: 69514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaatgtaacatttttcagt

SEQ ID NO: 69515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtatgtacttgaaatgta

SEQ ID NO: 69516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagtatgtacttgaaatgt

SEQ ID NO: 69517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgaagcaaacagtttata

SEQ ID NO: 69518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtgtgaagcaaacagttt

SEQ ID NO: 69519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgtgtgaagcaaacagtt

SEQ ID NO: 69520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgtgtgaagcaaacagt

SEQ ID NO: 69521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttgtgtgaagcaaacag

SEQ ID NO: 69522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgttgtgtgaagcaaaca

SEQ ID NO: 69523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgttgtgtgaagcaaac

SEQ ID NO: 69524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgttgtgtgaagcaaa

SEQ ID NO: 69525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgttgtgtgaagcaa

SEQ ID NO: 69526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttttgttgtgtgaagca

SEQ ID NO: 69527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaatatctttttttttgt

SEQ ID NO: 69528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagaatatctttttttttg

SEQ ID NO: 69529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttaaagaatatcttttttt

SEQ ID NO: 69530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctccttaaagaatatctttt

SEQ ID NO: 69531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctccttaaagaatatctt

SEQ ID NO: 69532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggctctgctccttaaagaat

SEQ ID NO: 69533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggctctgctccttaaaga

SEQ ID NO: 69534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggtgaaataaccattctag

SEQ ID NO: 69535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggctcaggtgaaataacca

SEQ ID NO: 69536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggctcaggtgaaataacc

SEQ ID NO: 69537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaggctcaggtgaaataac

SEQ ID NO: 69538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagtattttaaggctcagg

SEQ ID NO: 69539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgagtattttaaggctcag

SEQ ID NO: 69540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgagtattttaaggctca

SEQ ID NO: 69541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtgagtattttaaggctc

SEQ ID NO: 69542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttttgtgagtattttaag

SEQ ID NO: 69543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtcttttgtgagtatttt

SEQ ID NO: 69544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgtcttttgtgagtattt

SEQ ID NO: 69545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttactgtcttttgtgagtat

SEQ ID NO: 69546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttactgtcttttgtgagta

SEQ ID NO: 69547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttactgtcttttgtgagt

SEQ ID NO: 69548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aactttcttactgtcttttg

SEQ ID NO: 69549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaactttcttactgtcttt

SEQ ID NO: 69550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcaactttcttactgtct

SEQ ID NO: 69551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctcaactttcttactgtc

SEQ ID NO: 69552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttctctcaactttcttact

SEQ ID NO: 69553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttctctcaactttcttac

SEQ ID NO: 69554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttgcttctctcaactttc

SEQ ID NO: 69555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttgcttctctcaacttt

SEQ ID NO: 69556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatttgcttctctcaactt

SEQ ID NO: 69557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgatttgcttctctcaact

SEQ ID NO: 69558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttttgatttgcttctctca

SEQ ID NO: 69559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctccttttgatttgcttctc

SEQ ID NO: 69560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacccatctcctccttttga

SEQ ID NO: 69561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacccatctcctccttttg

SEQ ID NO: 69562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatacccatctcctcctttt

SEQ ID NO: 69563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatacccatctcctccttt

SEQ ID NO: 69564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttatacccatctcctcct

SEQ ID NO: 69565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttttatacccatctcctc

SEQ ID NO: 69566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcttttatacccatctcct

SEQ ID NO: 69567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctcttttatacccatctc

SEQ ID NO: 69568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctcttttatacccatct

SEQ ID NO: 69569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttctcttttatacccatc

SEQ ID NO: 69570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttctcttttatacccat

SEQ ID NO: 69571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccataatttttcttctcttt

SEQ ID NO: 69572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctgccataatttttcttct

SEQ ID NO: 69573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccactgtctgccataatttt

SEQ ID NO: 69574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accactgtctgccataattt

SEQ ID NO: 69575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttaccactgtctgccata

SEQ ID NO: 69576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtttaccactgtctgccat

SEQ ID NO: 69577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagataatggagcttagtt

SEQ ID NO: 69578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaacagataatggagctta

SEQ ID NO: 69579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attaacagataatggagctt

SEQ ID NO: 69580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttattaacagataatggag

SEQ ID NO: 69581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcttattaacagataatgga

SEQ ID NO: 69582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgcttattaacagataatg

SEQ ID NO: 69583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgcttattaacagataat

SEQ ID NO: 69584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttgcttattaacagataa

SEQ ID NO: 69585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgtctttcttgcttatt

SEQ ID NO: 69586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatgtctttcttgcttat

SEQ ID NO: 69587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatgtctttcttgctta

SEQ ID NO: 69588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttaaaatgtctttcttg

SEQ ID NO: 69589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaactaattttaaaatgtct

SEQ ID NO: 69590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaactaattttaaaatgtc

SEQ ID NO: 69591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagatggataatagtaact

SEQ ID NO: 69592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaaaagatggataatag

SEQ ID NO: 69593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacaattaaattaaaagatg

SEQ ID NO: 69594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accgtaaaactacacaatta

SEQ ID NO: 69595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagatattgaccgtaaaact

SEQ ID NO: 69596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagaacacaattatagatat

SEQ ID NO: 69597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgattcaagaacacaatta

SEQ ID NO: 69598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatgattcaagaacacaatt

SEQ ID NO: 69599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttaatgattcaagaacaca

SEQ ID NO: 69600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctccttaatgattcaagaac

SEQ ID NO: 69601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actccttaatgattcaagaa

SEQ ID NO: 69602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactccttaatgattcaaga

SEQ ID NO: 69603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttactccttaatgattca

SEQ ID NO: 69604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctattttactccttaatgat

SEQ ID NO: 69605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actattttactccttaatga

SEQ ID NO: 69606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatttactattttactcct

SEQ ID NO: 69607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgaaatttactattttac

SEQ ID NO: 69608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattgaaatttactatttta

SEQ ID NO: 69609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taattgaaatttactatttt

SEQ ID NO: 69610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcctttaattgaaatttac

SEQ ID NO: 69611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcctttaattgaaattta

SEQ ID NO: 69612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatcctttaattgaaattt

SEQ ID NO: 69613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaggatcctttgatccttt

SEQ ID NO: 69614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaaggatcctttgatcct

SEQ ID NO: 69615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcaaaggatcctttgatcc

SEQ ID NO: 69616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctcaaaggatcctttgat

SEQ ID NO: 69617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctcaaaggatcctttga

SEQ ID NO: 69618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgtggatttcttctcaaa

SEQ ID NO: 69619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgccacatagtaactatgtg

SEQ ID NO: 69620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgccacatagtaactatgt

SEQ ID NO: 69621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttatgccacatagtaactat

SEQ ID NO: 69622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gactcttatgccacatagta

SEQ ID NO: 69623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaatattggactcttatg

SEQ ID NO: 69624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaaaatattggactcttat

SEQ ID NO: 69625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taacataatgggaaacttgg

SEQ ID NO: 69626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcctgtaacataatgggaaa

SEQ ID NO: 69627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttgtcctgtaacataatgg

SEQ ID NO: 69628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacatctagttgtcctgtaa

SEQ ID NO: 69629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacatctagttgtcctgta

SEQ ID NO: 69630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caccagaagagagtatttaa

SEQ ID NO: 69631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaccagaagagagtattt

SEQ ID NO: 69632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctacaccagaagagagta

SEQ ID NO: 69633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttctacaccagaagagagt

SEQ ID NO: 69634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttctacaccagaagagag

SEQ ID NO: 69635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttctacaccagaagaga

SEQ ID NO: 69636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttgttctacaccagaag

SEQ ID NO: 69637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caagagagaagaaaggttat

SEQ ID NO: 69638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatgattgcaagagagaaga

SEQ ID NO: 69639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagaaggaaaaaaataaagg

SEQ ID NO: 69640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccagaaggaaaaaaataaa

SEQ ID NO: 69641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccagaaggaaaaaaataa

SEQ ID NO: 69642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatttctccagaaggaaaa

SEQ ID NO: 69643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taagaggataatgttcacat

SEQ ID NO: 69644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tataagaggataatgttcac

SEQ ID NO: 69645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaactctataagaggataa

SEQ ID NO: 69646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaactctataagaggata

SEQ ID NO: 69647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaactctataagaggat

SEQ ID NO: 69648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caattttaaaaactctataa

SEQ ID NO: 69649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgacctccaattttaaaaa

SEQ ID NO: 69650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atagtaatatcaataatatt

SEQ ID NO: 69651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagatgaaaagcactaatag

SEQ ID NO: 69652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactcaagatgaaaagcact

SEQ ID NO: 69653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaatgtgattacactcaa

SEQ ID NO: 69654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatcatgttaagaaatgtga

SEQ ID NO: 69655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaggggcccagaaatctaaa

SEQ ID NO: 69656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagagacctcaaggggccca

SEQ ID NO: 69657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatcaaaaaaaaaagattg

SEQ ID NO: 69658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatcaaaaaaaaaagatt

SEQ ID NO: 69659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaatttcatatcaaaaaa

SEQ ID NO: 69660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagaaatttcatatcaaaaa

SEQ ID NO: 69661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagaatcttgagaaattt

SEQ ID NO: 69662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaagaatcttgagaaatt

SEQ ID NO: 69663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaagaatcttgagaaat

SEQ ID NO: 69664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaaagaatcttgagaaa

SEQ ID NO: 69665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttttaaaaagaatcttga

SEQ ID NO: 69666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggcattaccttttaaaaag

SEQ ID NO: 69667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggcattaccttttaaaaa

SEQ ID NO: 69668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttgaggcattacctttta

SEQ ID NO: 69669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacttgaggcattacctttt

SEQ ID NO: 69670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacttgaggcattaccttt

SEQ ID NO: 69671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaacttgaggcattacctt

SEQ ID NO: 69672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaacttgaggcattacct

SEQ ID NO: 69673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgattttttaacttgagg

SEQ ID NO: 69674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtgattttttaacttgag

SEQ ID NO: 69675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcttcagtgattttttaac

SEQ ID NO: 69676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgagcttcagtgatttttt

SEQ ID NO: 69677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaattcctgagcttcagtga

SEQ ID NO: 69678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgaaattcctgagcttcag

SEQ ID NO: 69679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgaaattcctgagcttca

SEQ ID NO: 69680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgaaattcctgagcttc

SEQ ID NO: 69681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcctgaaattcctgagctt

SEQ ID NO: 69682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcctgaaattcctgagct

SEQ ID NO: 69683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcctgaaattcctgagc

SEQ ID NO: 69684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttttttcctgaaattcc

SEQ ID NO: 69685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatttttttcctgaaattc

SEQ ID NO: 69686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttccatttttttcctgaaa

SEQ ID NO: 69687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attatttccatttttttcct

SEQ ID NO: 69688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattatttccatttttttcc

SEQ ID NO: 69689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattatttccatttttttc

SEQ ID NO: 69690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaattatttccattttttt

SEQ ID NO: 69691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaattatttccatttttt

SEQ ID NO: 69692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtattttttaattatttc

SEQ ID NO: 69693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcaataatatctggagtat

SEQ ID NO: 69694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactgatcaataatatctgg

SEQ ID NO: 69695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccactgatcaataatatctg

SEQ ID NO: 69696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccactgatcaataatatct

SEQ ID NO: 69697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttttccactgatcaataa

SEQ ID NO: 69698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacaacagaagaaaatacag

SEQ ID NO: 69699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agacaacagaagaaaataca

SEQ ID NO: 69700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacttagacaacagaagaa

SEQ ID NO: 69701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtggaagtaacattaaaact

SEQ ID NO: 69702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattagtggaagtaacatta

SEQ ID NO: 69703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctaaattagtggaagtaaca

SEQ ID NO: 69704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgctaaattagtggaagtaa

SEQ ID NO: 69705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgctaaattagtggaagta

SEQ ID NO: 69706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgctaaattagtggaagt

SEQ ID NO: 69707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acaattttctgctaaattag

SEQ ID NO: 69708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaactgacaattttctgc

SEQ ID NO: 69709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttaataaactgacaatttt

SEQ ID NO: 69710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caactagttaataaactgac

SEQ ID NO: 69711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcaactagttaataaact

SEQ ID NO: 69712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgcaactagttaataaac

SEQ ID NO: 69713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatgtgagcccagaattta

SEQ ID NO: 69714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccataattagaatgtgagc

SEQ ID NO: 69715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttgcccataattagaatgt

SEQ ID NO: 69716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttgcccataattagaatg

SEQ ID NO: 69717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagttgcccataattagaat

SEQ ID NO: 69718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagttttagttgcccataat

SEQ ID NO: 69719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaagagctaaagtttta

SEQ ID NO: 69720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaaagagctaaagtttt

SEQ ID NO: 69721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaaagagctaaagttt

SEQ ID NO: 69722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaaaagagctaaagtt

SEQ ID NO: 69723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaaaaagagctaaagt

SEQ ID NO: 69724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaaaaaagagctaaag

SEQ ID NO: 69725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttaaaaaaagagctaaa

SEQ ID NO: 69726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccctttttttaaaaaaagag

SEQ ID NO: 69727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccctttttttaaaaaaaga

SEQ ID NO: 69728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgccctttttttaaaaaaa

SEQ ID NO: 69729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgccctttttttaaaaaa

SEQ ID NO: 69730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgccctttttttaaaaa

SEQ ID NO: 69731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttttcttgcccttttttta

SEQ ID NO: 69732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcaatagacaaagaaaaata

SEQ ID NO: 69733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctagcaatagacaaagaaaa

SEQ ID NO: 69734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctagcaatagacaaagaa

SEQ ID NO: 69735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgctagcaatagacaaag

SEQ ID NO: 69736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctgctagcaatagacaaa

SEQ ID NO: 69737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacaatatttctctgctagc

SEQ ID NO: 69738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccagagcctacacaatattt

SEQ ID NO: 69739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcccagagcctacacaata

SEQ ID NO: 69740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcctcccagagcctacaca

SEQ ID NO: 69741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aataagtagctattcctccc

SEQ ID NO: 69742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acgctgaataagtagctatt

SEQ ID NO: 69743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacgctgaataagtagctat

SEQ ID NO: 69744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgtttcacgctgaataag

SEQ ID NO: 69745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatggaactgtgtgtttca

SEQ ID NO: 69746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgatggaactgtgtgtttc

SEQ ID NO: 69747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accttgtgatggaactgtgt

SEQ ID NO: 69748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatcatgttgaccttgtg

SEQ ID NO: 69749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accaacagaatactatatat

SEQ ID NO: 69750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccaacagaatactatata

SEQ ID NO: 69751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcaccaacagaatactat

SEQ ID NO: 69752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attatttcaccaacagaata

SEQ ID NO: 69753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acctcattatttcaccaaca

SEQ ID NO: 69754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacctcattatttcaccaac

SEQ ID NO: 69755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatttgacctcattatttc

SEQ ID NO: 69756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtggtggctgagatttgacc

SEQ ID NO: 69757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggtggtggctgagatttga

SEQ ID NO: 69758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctggtggtggctgagattt

SEQ ID NO: 69759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctggtggtggctgagatt

SEQ ID NO: 69760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatttctctggtggtggctg

SEQ ID NO: 69761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaatttctctggtggtggc

SEQ ID NO: 69762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctgaatttctctggtggt

SEQ ID NO: 69763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctgaatttctctggtgg

SEQ ID NO: 69764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattctgaatttctctggtg

SEQ ID NO: 69765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttttattctgaatttctct

SEQ ID NO: 69766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgtgaaatcactggttttat

SEQ ID NO: 69767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaaaaagaagaggtctccg

SEQ ID NO: 69768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagaaaaagaagaggtctc

SEQ ID NO: 69769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtagaagattctgagaaaa

SEQ ID NO: 69770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatagaaagtgccctaggta

SEQ ID NO: 69771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggatagaaagtgccctag

SEQ ID NO: 69772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgttattggatagaaagtg

SEQ ID NO: 69773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgttattggatagaaagt

SEQ ID NO: 69774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgttattggatagaaag

SEQ ID NO: 69775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcacgtaagttttcatgtt

SEQ ID NO: 69776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcacgtaagttttcatgt

SEQ ID NO: 69777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatttagtcacgtaagttt

SEQ ID NO: 69778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcatttagtcacgtaagtt

SEQ ID NO: 69779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatcttatcatttagtcac

SEQ ID NO: 69780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattcatatcttatcattta

SEQ ID NO: 69781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattcatatcttatcattt

SEQ ID NO: 69782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatattcatatcttatcatt

SEQ ID NO: 69783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttatattcatatcttatca

SEQ ID NO: 69784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttatattcatatcttatc

SEQ ID NO: 69785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgatttctttatattcat

SEQ ID NO: 69786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgatttctttatattca

SEQ ID NO: 69787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatgatttctttatattc

SEQ ID NO: 69788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatatgatttctttatatt

SEQ ID NO: 69789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttatatgatttctttat

SEQ ID NO: 69790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgcttttatatgatttctt

SEQ ID NO: 69791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgttgcttttatatgattt

SEQ ID NO: 69792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catggccaactgttgttgct

SEQ ID NO: 69793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatggccaactgttgttgc

SEQ ID NO: 69794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacatggccaactgttgtt

SEQ ID NO: 69795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttacatggccaactgttgt

SEQ ID NO: 69796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gccttcttacatggccaact

SEQ ID NO: 69797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagccagtctagccttctta

SEQ ID NO: 69798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaaatctgtagccagtcta

SEQ ID NO: 69799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctgagaaatctgtagccag

SEQ ID NO: 69800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggacctggctgagaaatc

SEQ ID NO: 69801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagatgatactataggacct

SEQ ID NO: 69802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagatgatactataggacc

SEQ ID NO: 69803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaagatgcttcaagatgat

SEQ ID NO: 69804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attagaaagatgcttcaaga

SEQ ID NO: 69805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattagaaagatgcttcaag

SEQ ID NO: 69806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattagaaagatgcttcaa

SEQ ID NO: 69807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcattagaaagatgcttca

SEQ ID NO: 69808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttcattagaaagatgctt

SEQ ID NO: 69809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttcattagaaagatgct

SEQ ID NO: 69810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcttttcattagaaagatg

SEQ ID NO: 69811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttcttttcattagaaaga

SEQ ID NO: 69812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcttcttttcattagaaag

SEQ ID NO: 69813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttctcttcttttcattaga

SEQ ID NO: 69814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttctcttcttttcattag

SEQ ID NO: 69815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcttctcttcttttcatta

SEQ ID NO: 69816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgcttctcttcttttcat

SEQ ID NO: 69817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctctttgcttctcttcttt

SEQ ID NO: 69818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctagctctttgcttctcttc

SEQ ID NO: 69819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactcctagctctttgcttc

SEQ ID NO: 69820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acactcctagctctttgctt

SEQ ID NO: 69821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacactcctagctctttgct

SEQ ID NO: 69822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatatcaatggccactttac

SEQ ID NO: 69823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatatcaatggccacttta

SEQ ID NO: 69824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgacagagcacagagagagc

SEQ ID NO: 69825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgacagagcacagagaga

SEQ ID NO: 69826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaacagtgtagcagttctg

SEQ ID NO: 69827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcaaacagtgtagcagttc

SEQ ID NO: 69828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgcaaacagtgtagcagt

SEQ ID NO: 69829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctgcaaacagtgtagcag

SEQ ID NO: 69830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctctgcaaacagtgtagca

SEQ ID NO: 69831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttctctgcaaacagtgta

SEQ ID NO: 69832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagctgctttctctgcaaac

SEQ ID NO: 69833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattccagctgctttctctg

SEQ ID NO: 69834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acccactgtattccagctgc

SEQ ID NO: 69835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacccactgtattccagctg

SEQ ID NO: 69836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acttgacccactgtattcca

SEQ ID NO: 69837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgacttgacccactgtattc

SEQ ID NO: 69838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agacactctgacttgaccca

SEQ ID NO: 69839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagacactctgacttgaccc

SEQ ID NO: 69840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagacactctgacttgacc

SEQ ID NO: 69841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagactttaagacactctga

SEQ ID NO: 69842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaagactttaagacactct

SEQ ID NO: 69843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaaagactttaagacactc

SEQ ID NO: 69844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttctaaagactttaagaca

SEQ ID NO: 69845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttctaaagactttaagac

SEQ ID NO: 69846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgtttgcttctaaagact

SEQ ID NO: 69847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgtttgcttctaaagac

SEQ ID NO: 69848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaaatgtttgcttctaaa

SEQ ID NO: 69849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcataaatagcaaaattgtt

SEQ ID NO: 69850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agctggcataaatagcaaaa

SEQ ID NO: 69851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagctggcataaatagcaaa

SEQ ID NO: 69852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagctggcataaatagcaa

SEQ ID NO: 69853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagctggcataaatagca

SEQ ID NO: 69854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaagctggcataaatagc

SEQ ID NO: 69855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaagctggcataaatag

SEQ ID NO: 69856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catttttttaagctggcata

SEQ ID NO: 69857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgcatttttttaagctggc

SEQ ID NO: 69858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttgcatttttttaagctgg

SEQ ID NO: 69859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgttgcatttttttaagc

SEQ ID NO: 69860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctacttgttgcattttttt

SEQ ID NO: 69861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctacttgttgcatttttt

SEQ ID NO: 69862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacctacttgttgcattttt

SEQ ID NO: 69863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttacctacttgttgcattt

SEQ ID NO: 69864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttacctacttgttgcatt

SEQ ID NO: 69865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caatccttctttacctactt

SEQ ID NO: 69866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggttccaatccttctttac

SEQ ID NO: 69867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaggttccaatccttctt

SEQ ID NO: 69868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctaaggttccaatccttct

SEQ ID NO: 69869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtttgctaaggttccaatc

SEQ ID NO: 69870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtttgctaaggttccaat

SEQ ID NO: 69871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgtttgctaaggttccaa

SEQ ID NO: 69872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctttatgtttgctaaggtt

SEQ ID NO: 69873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctttatgtttgctaaggt

SEQ ID NO: 69874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcctttatgtttgctaagg

SEQ ID NO: 69875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cactttgcctttatgtttgc

SEQ ID NO: 69876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgtatctacactttgccttt

SEQ ID NO: 69877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtctgcgtatctacacttt

SEQ ID NO: 69878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtctgcgtatctacactt

SEQ ID NO: 69879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgaagcttgagtctgcgtat

SEQ ID NO: 69880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgaagcttgagtctgcgta

SEQ ID NO: 69881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagataatatttacgaagct

SEQ ID NO: 69882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaattatagataatattta

SEQ ID NO: 69883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaattatagataatattt

SEQ ID NO: 69884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcaaaattatagataata

SEQ ID NO: 69885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttcaaaattatagataat

SEQ ID NO: 69886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtttcaaaattatagat

SEQ ID NO: 69887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttgtttcaaaattataga

SEQ ID NO: 69888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtttgtttcaaaattata

SEQ ID NO: 69889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcattcttgtttgtttcaaa

SEQ ID NO: 69890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcattcttgtttgtttcaa

SEQ ID NO: 69891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttgtcattcttgtttgt

SEQ ID NO: 69892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtttgtcattcttgtttg

SEQ ID NO: 69893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgtttgtcattcttgttt

SEQ ID NO: 69894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttgtgtttgtcattcttg

SEQ ID NO: 69895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actttgtgtttgtcattctt

SEQ ID NO: 69896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtagcttactttgtgtttg

SEQ ID NO: 69897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatatctaggtagcttact

SEQ ID NO: 69898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagaaatgattcagatatc

SEQ ID NO: 69899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagttaacagaaatgattc

SEQ ID NO: 69900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgggtagtattagtagttaa

SEQ ID NO: 69901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgtgggtagtattagtag

SEQ ID NO: 69902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattgtgggtagtattagta

SEQ ID NO: 69903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttcattgtgggtagtatta

SEQ ID NO: 69904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccctccttcattgtgggtag

SEQ ID NO: 69905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccctccttcattgtgggta

SEQ ID NO: 69906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgccctccttcattgtgg

SEQ ID NO: 69907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttgccctccttcattgtg

SEQ ID NO: 69908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttgccctccttcattgt

SEQ ID NO: 69909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccttgccctccttcattg

SEQ ID NO: 69910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttttccttgccctccttc

SEQ ID NO: 69911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattcacttttccttgccc

SEQ ID NO: 69912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaaaattcacttttcctt

SEQ ID NO: 69913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattcattaaaattcacttt

SEQ ID NO: 69914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttccattcattaaaattcac

SEQ ID NO: 69915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtaattattccattcattaa

SEQ ID NO: 69916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagctagtaattattcca

SEQ ID NO: 69917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaagctagtaattattcc

SEQ ID NO: 69918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaatccacatgtttaaaaa

SEQ ID NO: 69919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatattagaaatccacatgt

SEQ ID NO: 69920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatattagaaatccacatg

SEQ ID NO: 69921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaatattagaaatccacat

SEQ ID NO: 69922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattttcaatattagaaatc

SEQ ID NO: 69923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattttcaatattagaaat

SEQ ID NO: 69924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttatattttcaatattaga

SEQ ID NO: 69925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatttatattttcaatatta

SEQ ID NO: 69926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatttatattttcaatatt

SEQ ID NO: 69927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccatgtaaaatttctattt

SEQ ID NO: 69928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccatgtaaaatttctatt

SEQ ID NO: 69929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatccatgtaaaatttctat

SEQ ID NO: 69930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttatccatgtaaaatttc

SEQ ID NO: 69931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cataaaggatatagttattt

SEQ ID NO: 69932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctacataaaggatatagtt

SEQ ID NO: 69933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaaaagctgcctacataaa

SEQ ID NO: 69934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcaaaagctgcctacataa

SEQ ID NO: 69935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagcaaaagctgcctacata

SEQ ID NO: 69936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatatggcactttagcaaa

SEQ ID NO: 69937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaatatggcactttagcaa

SEQ ID NO: 69938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaatgacttgaaatatggc

SEQ ID NO: 69939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttaagaatgacttgaaat

SEQ ID NO: 69940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatattcagttaagaatgac

SEQ ID NO: 69941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaaaaaactgaatattca

SEQ ID NO: 69942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagaaaaaaactgaatattc

SEQ ID NO: 69943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaagaaaaaaactgaatat

SEQ ID NO: 69944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaatggtcatcctcttaa

SEQ ID NO: 69945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaagatgaggtacatgtt

SEQ ID NO: 69946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttagaaaagatgaggtacat

SEQ ID NO: 69947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaagctgttagaaaagatg

SEQ ID NO: 69948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accaagctgttagaaaagat

SEQ ID NO: 69949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taccaagctgttagaaaaga

SEQ ID NO: 69950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaccaagctgttagaaaag

SEQ ID NO: 69951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaccaagctgttagaaaa

SEQ ID NO: 69952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttaccaagctgttagaaa

SEQ ID NO: 69953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttttttaccaagctgttag

SEQ ID NO: 69954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacttttttaccaagctgt

SEQ ID NO: 69955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attacttttttaccaagctg

SEQ ID NO: 69956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattacttttttaccaagc

SEQ ID NO: 69957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaattcttattacttttt

SEQ ID NO: 69958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattcataaattcttattac

SEQ ID NO: 69959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattcataaattcttatta

SEQ ID NO: 69960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaattcataaattcttatt

SEQ ID NO: 69961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaatatatatacatgcata

SEQ ID NO: 69962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagaaatatatatacatgca

SEQ ID NO: 69963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagaaatatatatacatgc

SEQ ID NO: 69964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctagaaatatatataca

SEQ ID NO: 69965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaagctatttctagaaat

SEQ ID NO: 69966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaaagctatttctagaaa

SEQ ID NO: 69967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagaaagctatttctagaa

SEQ ID NO: 69968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagaaagctatttctaga

SEQ ID NO: 69969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataggtatagataaaacat

SEQ ID NO: 69970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctatataggtatagataaa

SEQ ID NO: 69971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aataaggatgcatatacacc

SEQ ID NO: 69972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagcctaaataaggatgcat

SEQ ID NO: 69973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aactagagcctaaataagga

SEQ ID NO: 69974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caactagagcctaaataagg

SEQ ID NO: 69975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcaactagagcctaaataa

SEQ ID NO: 69976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcaactagagcctaaata

SEQ ID NO: 69977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttcaactagagcctaaat

SEQ ID NO: 69978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagaatatggtgaattttct

SEQ ID NO: 69979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttccagaatatggtgaattt

SEQ ID NO: 69980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attccagaatatggtgaatt

SEQ ID NO: 69981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattccagaatatggtgaat

SEQ ID NO: 69982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttattccagaatatggtg

SEQ ID NO: 69983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atagaaaactattttattcc

SEQ ID NO: 69984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatagaaaactattttatt

SEQ ID NO: 69985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaggcaatattctcatagaa

SEQ ID NO: 69986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaggcaatattctcataga

SEQ ID NO: 69987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtggggatttagaggcaata

SEQ ID NO: 69988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtggggatttagaggcaat

SEQ ID NO: 69989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatttggtggggatttaga

SEQ ID NO: 69990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatttggtggggatttag

SEQ ID NO: 69991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcaaatttggtggggatt

SEQ ID NO: 69992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatttcaaatttggtgggga

SEQ ID NO: 69993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatttcaaatttggtgggg

SEQ ID NO: 69994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctatttcaaatttggtggg

SEQ ID NO: 69995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctatttcaaatttggtgg

SEQ ID NO: 69996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtaaaagatatatttttct

SEQ ID NO: 69997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggtggcctaagtaaaaga

SEQ ID NO: 69998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaggtggcctaagtaaaag

SEQ ID NO: 69999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaggtggcctaagtaaaa

SEQ ID NO: 70000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagataattttaaaggtggc

SEQ ID NO: 70001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagataattttaaaggtgg

SEQ ID NO: 70002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgaagataattttaaagg

SEQ ID NO: 70003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgaagataattttaaag

SEQ ID NO: 70004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagtttatttgaagataatt

SEQ ID NO: 70005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgttccagtttatttgaag

SEQ ID NO: 70006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgttccagtttatttgaa

SEQ ID NO: 70007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgttccagtttatttga

SEQ ID NO: 70008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttagtgttccagtttatt

SEQ ID NO: 70009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttattttagtgttccagtt

SEQ ID NO: 70010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatgaaaaattagttattt

SEQ ID NO: 70011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatgaaaaattagttatt

SEQ ID NO: 70012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acagtttcaaatgaaaaatt

SEQ ID NO: 70013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaacagtttcaaatgaaaa

SEQ ID NO: 70014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagataatattgctaacagt

SEQ ID NO: 70015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agagataatattgctaacag

SEQ ID NO: 70016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acacaccttagagataatat

SEQ ID NO: 70017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaattgacacaccttagaga

SEQ ID NO: 70018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctgaaattgacacacctt

SEQ ID NO: 70019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcctgaaattgacacacct

SEQ ID NO: 70020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatcctgaaattgacacacc

SEQ ID NO: 70021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcaatgatgaaagcaaaac

SEQ ID NO: 70022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgtgcaatgatgaaagcaa

SEQ ID NO: 70023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctattgtgcaatgatgaaa

SEQ ID NO: 70024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatctattgtgcaatgatg

SEQ ID NO: 70025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgttatctattgtgcaatg

SEQ ID NO: 70026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattattgttatctattgtg

SEQ ID NO: 70027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattattgttatctattgt

SEQ ID NO: 70028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatgtttgtattattgtta

SEQ ID NO: 70029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgagatgtttgtattattg

SEQ ID NO: 70030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcattgttgagatgtttgta

SEQ ID NO: 70031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtcattgttgagatgtttg

SEQ ID NO: 70032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgtcattgttgagatgtt

SEQ ID NO: 70033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctgtcattgttgagatgt

SEQ ID NO: 70034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatttctctgtcattgttga

SEQ ID NO: 70035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatttctctgtcattgttg

SEQ ID NO: 70036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaatttctctgtcattgtt

SEQ ID NO: 70037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atattttgaatttctctgtc

SEQ ID NO: 70038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttcatattttgaatttctc

SEQ ID NO: 70039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatctagttcatattttga

SEQ ID NO: 70040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatctagttcatattttg

SEQ ID NO: 70041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataatctagttcatatttt

SEQ ID NO: 70042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttataatctagttcatattt

SEQ ID NO: 70043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttataatctagttcatatt

SEQ ID NO: 70044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctttttataatctagttcat

SEQ ID NO: 70045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actcctttttataatctagt

SEQ ID NO: 70046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gactcctttttataatctag

SEQ ID NO: 70047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaataagaatcttgactcc

SEQ ID NO: 70048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgccaataagaatcttgact

SEQ ID NO: 70049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggatgggggcaggaatctct

SEQ ID NO: 70050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggatgggggcaggaatct

SEQ ID NO: 70051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagttctaggatgggggca

SEQ ID NO: 70052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatagttctaggatgggggc

SEQ ID NO: 70053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatagttctaggatggggg

SEQ ID NO: 70054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aactttaatagttctaggat

SEQ ID NO: 70055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgactgaactttaatagt

SEQ ID NO: 70056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgaatgactgaactttaat

SEQ ID NO: 70057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgaatgactgaactttaa

SEQ ID NO: 70058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttgaatgactgaacttta

SEQ ID NO: 70059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatactttgttgaatgact

SEQ ID NO: 70060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcatactttgttgaatgac

SEQ ID NO: 70061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagcatactttgttgaatga

SEQ ID NO: 70062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttagcatactttgttga

SEQ ID NO: 70063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttagcatactttgttg

SEQ ID NO: 70064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattttagcatactttgtt

SEQ ID NO: 70065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agatatattttaattttagc

SEQ ID NO: 70066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatacatactaagatatat

SEQ ID NO: 70067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatgtattaaaatacatac

SEQ ID NO: 70068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaatgtattaaaatacat

SEQ ID NO: 70069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaaatgtattaaaataca

SEQ ID NO: 70070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatatttctaaaatgtatta

SEQ ID NO: 70071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaatatttctaaaatgta

SEQ ID NO: 70072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgaatatttctaaaatgt

SEQ ID NO: 70073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccttattgaatatttctaaa

SEQ ID NO: 70074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatgtattgccttattgaa

SEQ ID NO: 70075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatacagattaatatgtatt

SEQ ID NO: 70076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaattagatacagattaata

SEQ ID NO: 70077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgaaattagatacagatta

SEQ ID NO: 70078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgaaattagatacagatt

SEQ ID NO: 70079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgaaattagatacagat

SEQ ID NO: 70080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttactgaaattagatacaga

SEQ ID NO: 70081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaataacacatagaacact

SEQ ID NO: 70082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctatcaataacacatagaa

SEQ ID NO: 70083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaatcctatctatcaataa

SEQ ID NO: 70084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatagagcatattataaatc

SEQ ID NO: 70085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatagagcatattataaat

SEQ ID NO: 70086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaggtttagatagagcata

SEQ ID NO: 70087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaactaagaggtttagata

SEQ ID NO: 70088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagaaactaagaggtttaga

SEQ ID NO: 70089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatacataatcagatcagtc

SEQ ID NO: 70090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attatatacataatcagatc

SEQ ID NO: 70091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgattatatacataatcaga

SEQ ID NO: 70092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgattatatacataatcag

SEQ ID NO: 70093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataagaataagtttctgatt

SEQ ID NO: 70094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgataagaataagtttct

SEQ ID NO: 70095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcattgataagaataagtt

SEQ ID NO: 70096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagaagtaatattactcatt

SEQ ID NO: 70097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttccagaagtaatattactc

SEQ ID NO: 70098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attccagaagtaatattact

SEQ ID NO: 70099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattccagaagtaatattac

SEQ ID NO: 70100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttattccagaagtaata

SEQ ID NO: 70101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttattccagaagtaat

SEQ ID NO: 70102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatgtttaattttattcc

SEQ ID NO: 70103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaatgaataagtgataagt

SEQ ID NO: 70104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctatgaatgaataagtgat

SEQ ID NO: 70105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcctatgaatgaataagtga

SEQ ID NO: 70106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataggccttgcctatgaatg

SEQ ID NO: 70107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagttgataggccttgcct

SEQ ID NO: 70108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataaaatgcatcagttaaa

SEQ ID NO: 70109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctatataaaatgcatcagtt

SEQ ID NO: 70110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcctatataaaatgcatca

SEQ ID NO: 70111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctcctatataaaatgcatc

SEQ ID NO: 70112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgctcctatataaaatgc

SEQ ID NO: 70113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgctcctatataaaatg

SEQ ID NO: 70114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttgctcctatataaaat

SEQ ID NO: 70115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttatttgctcctatata

SEQ ID NO: 70116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattttatttgctcctatat

SEQ ID NO: 70117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatttgattttatttgctc

SEQ ID NO: 70118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtaattaacatttgatttt

SEQ ID NO: 70119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcaactcagtaattaaca

SEQ ID NO: 70120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatcaactcagtaattaac

SEQ ID NO: 70121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatcaactcagtaattaa

SEQ ID NO: 70122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatcaactcagtaatta

SEQ ID NO: 70123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaatcaactcagtaatt

SEQ ID NO: 70124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaatcaactcagtaat

SEQ ID NO: 70125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttttaaatcaactcagt

SEQ ID NO: 70126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttttaaatcaactcag

SEQ ID NO: 70127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttttttaaatcaactca

SEQ ID NO: 70128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgggactttatttttttaaa

SEQ ID NO: 70129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttatgggactttatttttt

SEQ ID NO: 70130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttagttatgggactttattt

SEQ ID NO: 70131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcactgttagttatgggac

SEQ ID NO: 70132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgcactgttagttatggga

SEQ ID NO: 70133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgcactgttagttatggg

SEQ ID NO: 70134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatggttttatgcactgtt

SEQ ID NO: 70135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaatggttttatgcactgt

SEQ ID NO: 70136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaatggttttatgcactg

SEQ ID NO: 70137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatacattttgaaatggttt

SEQ ID NO: 70138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatacattttgaaatggtt

SEQ ID NO: 70139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaatacattttgaaatggt

SEQ ID NO: 70140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtataaactttgaatacatt

SEQ ID NO: 70141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagtataaactttgaataca

SEQ ID NO: 70142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctagtataaactttgaatac

SEQ ID NO: 70143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttctagtataaactttgaa

SEQ ID NO: 70144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggtcaaagccaaagtaccc

SEQ ID NO: 70145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaagttggggtcaaagcca

SEQ ID NO: 70146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtacacatctagaaagttgg

SEQ ID NO: 70147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtacacatctagaaagttg

SEQ ID NO: 70148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagtacacatctagaaagt

SEQ ID NO: 70149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttagtacacatctagaaag

SEQ ID NO: 70150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttagtacacatctagaaa

SEQ ID NO: 70151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgctttcttagtacacatc

SEQ ID NO: 70152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agactcatgctttcttagta

SEQ ID NO: 70153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggataagcaaattgagact

SEQ ID NO: 70154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggataagcaaattgagac

SEQ ID NO: 70155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtatttatggataagcaaa

SEQ ID NO: 70156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttatgtatttatggataag

SEQ ID NO: 70157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggttatgtatttatggata

SEQ ID NO: 70158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataattctggttatgtattt

SEQ ID NO: 70159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataattctggttatgtatt

SEQ ID NO: 70160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttaataattctggttat

SEQ ID NO: 70161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttaataattctggtta

SEQ ID NO: 70162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtatttaataattctggtt

SEQ ID NO: 70163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctttgtatttaataattct

SEQ ID NO: 70164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagctttgtatttaataatt

SEQ ID NO: 70165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taattctagctttgtattta

SEQ ID NO: 70166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagcaggaaaagatcattg

SEQ ID NO: 70167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcataaatataaaatctcag

SEQ ID NO: 70168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggcataaatataaaatctc

SEQ ID NO: 70169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggcataaatataaaatct

SEQ ID NO: 70170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggaagaagtgtttctggca

SEQ ID NO: 70171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaaattgtggaagaagtgt

SEQ ID NO: 70172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaaaaattgtggaagaagt

SEQ ID NO: 70173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtagatcaaaactctaaaa

SEQ ID NO: 70174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaagtagatcaaaactc

SEQ ID NO: 70175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattaagtagatcaaaact

SEQ ID NO: 70176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcacatttaaattaagtaga

SEQ ID NO: 70177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgtcacatttaaattaa

SEQ ID NO: 70178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cataaaaatatggagagatg

SEQ ID NO: 70179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctacataaaaatatggag

SEQ ID NO: 70180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatctacataaaaatatgga

SEQ ID NO: 70181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttaatctacataaaaata

SEQ ID NO: 70182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgatttaatctacataaaa

SEQ ID NO: 70183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgatttaatctacataaa

SEQ ID NO: 70184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttcctgatttaatctaca

SEQ ID NO: 70185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccttcctgatttaatctac

SEQ ID NO: 70186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaacttcccttcctgattt

SEQ ID NO: 70187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatcaacttcccttcctgat

SEQ ID NO: 70188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaacctctatcaacttccc

SEQ ID NO: 70189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaacctctatcaacttcc

SEQ ID NO: 70190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttgaaaacctctatcaac

SEQ ID NO: 70191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttgaaaacctctatcaa

SEQ ID NO: 70192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catttaatttgaaaacctct

SEQ ID NO: 70193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagctacatttaatttgaaa

SEQ ID NO: 70194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaagtaaaatgcagaatg

SEQ ID NO: 70195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attataaaagtaaaatgcag

SEQ ID NO: 70196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattgattataaaagtaaaa

SEQ ID NO: 70197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaattgattataaaagta

SEQ ID NO: 70198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgaattgattataaaagt

SEQ ID NO: 70199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgaattgattataaaag

SEQ ID NO: 70200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattgaattgattataaaa

SEQ ID NO: 70201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagatttttattgaattgat

SEQ ID NO: 70202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtgcatgatctgtagatt

SEQ ID NO: 70203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagtgcatgatctgtagat

SEQ ID NO: 70204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgatttcaagtgcatgat

SEQ ID NO: 70205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagtgatttcaagtgcatga

SEQ ID NO: 70206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtgcttaagtgatttcaa

SEQ ID NO: 70207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgtgcttaagtgatttca

SEQ ID NO: 70208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtaaccttcatgtgctta

SEQ ID NO: 70209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatgtaaccttcatgtgctt

SEQ ID NO: 70210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgatgtaaccttcatgtgc

SEQ ID NO: 70211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgatgtaaccttcatgtg

SEQ ID NO: 70212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgacttcttgatgtaacct

SEQ ID NO: 70213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatgacttcttgatgtaacc

SEQ ID NO: 70214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgatgacttcttgatgtaa

SEQ ID NO: 70215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttgatgacttcttgatgt

SEQ ID NO: 70216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgattctcttgatgacttct

SEQ ID NO: 70217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgattctcttgatgacttc

SEQ ID NO: 70218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgattctcttgatgactt

SEQ ID NO: 70219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgattctcttgatgact

SEQ ID NO: 70220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtgattctcttgatgac

SEQ ID NO: 70221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgtgattctcttgatga

SEQ ID NO: 70222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttttgtgattctcttga

SEQ ID NO: 70223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attatttttttgtgattctc

SEQ ID NO: 70224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattatttttttgtgattct

SEQ ID NO: 70225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatagataaagtgacatcac

SEQ ID NO: 70226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcaatagataaagtgacat

SEQ ID NO: 70227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caagaaagtagaaacatata

SEQ ID NO: 70228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acccactgcaagaaagtaga

SEQ ID NO: 70229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctgacccactgcaagaaag

SEQ ID NO: 70230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcctgacccactgcaagaa

SEQ ID NO: 70231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcctgacccactgcaaga

SEQ ID NO: 70232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgcctgacccactgcaag

SEQ ID NO: 70233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaacctttctgcctgacc

SEQ ID NO: 70234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctacaaaacctttctgcc

SEQ ID NO: 70235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcagctacaaaacctttct

SEQ ID NO: 70236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgctgttcagctacaaaa

SEQ ID NO: 70237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcatgctgttcagctacaaa

SEQ ID NO: 70238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgtcttgcatgctgttca

SEQ ID NO: 70239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatgtcttgcatgctgttc

SEQ ID NO: 70240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaatgtcttgcatgctgtt

SEQ ID NO: 70241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaatgtcttgcatgctgt

SEQ ID NO: 70242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcaatgtcttgcatgctg

SEQ ID NO: 70243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaaaatcatacatacgata

SEQ ID NO: 70244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctaaaaaaatcatacatac

SEQ ID NO: 70245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacaggttacctaaaaaaat

SEQ ID NO: 70246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acacaggttacctaaaaaaa

SEQ ID NO: 70247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacacaggttacctaaaaaa

SEQ ID NO: 70248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttacacaggttacctaaaaa

SEQ ID NO: 70249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accaggcagagacatatgtc

SEQ ID NO: 70250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaccaggcagagacatatgt

SEQ ID NO: 70251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaccaggcagagacatatg

SEQ ID NO: 70252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaccaggcagagacatat

SEQ ID NO: 70253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcttttaaccaggcagaga

SEQ ID NO: 70254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtgcttttaaccaggcaga

SEQ ID NO: 70255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatcagtcaaggatgcagct

SEQ ID NO: 70256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaggggtaatatcaaactg

SEQ ID NO: 70257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcacaggggtaatatcaaac

SEQ ID NO: 70258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcacaggggtaatatcaaa

SEQ ID NO: 70259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctcacaggggtaatatca

SEQ ID NO: 70260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttctcacaggggtaatatc

SEQ ID NO: 70261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
accttcttctcacaggggta

SEQ ID NO: 70262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtacctaaccttcttctca

SEQ ID NO: 70263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaattcagtacctaaccttc

SEQ ID NO: 70264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaattcagtacctaacct

SEQ ID NO: 70265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaaattcagtacctaacc

SEQ ID NO: 70266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catttctaaaattcagtacc

SEQ ID NO: 70267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcatgctgcatttctaaaa

SEQ ID NO: 70268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcatgctgcatttctaaa

SEQ ID NO: 70269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatcatgctgcatttctaa

SEQ ID NO: 70270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttcatcatgctgcatttct

SEQ ID NO: 70271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactctttcatcatgctgca

SEQ ID NO: 70272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actaaactctttcatcatgc

SEQ ID NO: 70273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacacagttgactaaactc

SEQ ID NO: 70274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacacagttgactaaact

SEQ ID NO: 70275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaacacagttgactaaac

SEQ ID NO: 70276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacattttaaaacacagttg

SEQ ID NO: 70277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacattttaaaacacagtt

SEQ ID NO: 70278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaacattttaaaacacagt

SEQ ID NO: 70279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggtatatgactttaaaca

SEQ ID NO: 70280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaggtatatgactttaaac

SEQ ID NO: 70281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttacaggtatatgacttta

SEQ ID NO: 70282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacttacaggtatatgactt

SEQ ID NO: 70283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacttacaggtatatgact

SEQ ID NO: 70284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttctacttacaggtatat

SEQ ID NO: 70285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatatgtaactaatttcta

SEQ ID NO: 70286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatatgtaactaatttct

SEQ ID NO: 70287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaatatgtaactaatttc

SEQ ID NO: 70288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtatatagcatgtactttc

SEQ ID NO: 70289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acgttgagtatatagcatgt

SEQ ID NO: 70290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacgttgagtatatagcatg

SEQ ID NO: 70291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttaacgttgagtatatagc

SEQ ID NO: 70292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatatattgcttaacgttg

SEQ ID NO: 70293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgattcaaatatattgctta

SEQ ID NO: 70294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtactgtgattcaaatatat

SEQ ID NO: 70295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtactgtgattcaaatata

SEQ ID NO: 70296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcttagtactgtgattcaa

SEQ ID NO: 70297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcttagtactgtgattca

SEQ ID NO: 70298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgacatttaatcttagta

SEQ ID NO: 70299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgaatgacatttaatctta

SEQ ID NO: 70300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttgaatgacatttaatct

SEQ ID NO: 70301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtctctgttgaatgacatt

SEQ ID NO: 70302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtctctgttgaatgacat

SEQ ID NO: 70303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtctctgttgaatgaca

SEQ ID NO: 70304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagtctctgttgaatgac

SEQ ID NO: 70305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttaagtctctgttgaat

SEQ ID NO: 70306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attgtttttaagtctctgtt

SEQ ID NO: 70307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgattgtttttaagtctc

SEQ ID NO: 70308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattgattgtttttaagtct

SEQ ID NO: 70309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttaattgattgtttttaag

SEQ ID NO: 70310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtaactgtttaattgattg

SEQ ID NO: 70311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatagtagagtagaattatg

SEQ ID NO: 70312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatagtagagtagaattat

SEQ ID NO: 70313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatagtagagtagaatta

SEQ ID NO: 70314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatagtagagtagaatt

SEQ ID NO: 70315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatttttaaatagtagagta

SEQ ID NO: 70316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattcaatttttaaatagta

SEQ ID NO: 70317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattcaatttttaaatagt

SEQ ID NO: 70318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtatttaaattcaatttt

SEQ ID NO: 70319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcacattatagtatttaaat

SEQ ID NO: 70320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattagcacattatagtatt

SEQ ID NO: 70321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggaaaaatagaatgcaaaa

SEQ ID NO: 70322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggaaaaatagaatgcaaa

SEQ ID NO: 70323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catttaaggaaaaatagaat

SEQ ID NO: 70324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcatttaaggaaaaatagaa

SEQ ID NO: 70325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgcatttaaggaaaaata

SEQ ID NO: 70326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgttgcttgcatttaagg

SEQ ID NO: 70327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgttgcttgcatttaag

SEQ ID NO: 70328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttaaatgttgcttgcat

SEQ ID NO: 70329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatttaaatgttgcttgca

SEQ ID NO: 70330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaatcacttatatttaaat

SEQ ID NO: 70331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactgagaatcacttatatt

SEQ ID NO: 70332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accccctatactgagaatca

SEQ ID NO: 70333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccacctcaccccctatactg

SEQ ID NO: 70334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgccacctcaccccctata

SEQ ID NO: 70335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgccacctcaccccctat

SEQ ID NO: 70336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttactgccacctcaccccct

SEQ ID NO: 70337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catactcttactgccacctc

SEQ ID NO: 70338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagctgcatactcttactgc

SEQ ID NO: 70339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagctgcatactcttactg

SEQ ID NO: 70340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagctgcatactcttact

SEQ ID NO: 70341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaagctgcatactcttac

SEQ ID NO: 70342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaaagctgcatactctta

SEQ ID NO: 70343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatatgctttttaaagctg

SEQ ID NO: 70344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaatatgctttttaaagct

SEQ ID NO: 70345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaatatgctttttaaagc

SEQ ID NO: 70346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttagaatatgcttttta

SEQ ID NO: 70347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataaaaataagtcaatcaa

SEQ ID NO: 70348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaaataaaaataagtcaa

SEQ ID NO: 70349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgtcaaaattaattaaa

SEQ ID NO: 70350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatgtcaaaattaattaa

SEQ ID NO: 70351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttaaaatgtcaaaattaat

SEQ ID NO: 70352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatgctgtttaaaatgtca

SEQ ID NO: 70353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaatgctgtttaaaatgtc

SEQ ID NO: 70354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcaatgctgtttaaaatgt

SEQ ID NO: 70355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcaatgctgtttaaaatg

SEQ ID NO: 70356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgcaatgctgtttaaaat

SEQ ID NO: 70357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttgcaatgctgtttaaaa

SEQ ID NO: 70358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttttttgcaatgctgttt

SEQ ID NO: 70359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacttttttgcaatgctgtt

SEQ ID NO: 70360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaacttcacttttttgcaa

SEQ ID NO: 70361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaacttcacttttttgca

SEQ ID NO: 70362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataaatttggaaacttcact

SEQ ID NO: 70363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gataaatttggaaacttcac

SEQ ID NO: 70364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgataaatttggaaacttca

SEQ ID NO: 70365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattttgataaatttggaaa

SEQ ID NO: 70366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattttgataaatttggaa

SEQ ID NO: 70367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatattttgataaatttgga

SEQ ID NO: 70368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttatattttgataaatttg

SEQ ID NO: 70369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctttatattttgataaat

SEQ ID NO: 70370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attctttatattttgataaa

SEQ ID NO: 70371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatcaatgtgtcttattct

SEQ ID NO: 70372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acatattcaaatcaatgtgt

SEQ ID NO: 70373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgacatattcaaatcaat

SEQ ID NO: 70374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctgacatattcaaatcaa

SEQ ID NO: 70375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaacaatgaaatatttgtc

SEQ ID NO: 70376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgtgcctaaaaacaatgaaa

SEQ ID NO: 70377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgtgcctaaaaacaatgaa

SEQ ID NO: 70378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttacgtgcctaaaaacaat

SEQ ID NO: 70379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttacgtgcctaaaaacaa

SEQ ID NO: 70380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatttgtttacgtgcctaaa

SEQ ID NO: 70381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggatttgtttacgtgcc

SEQ ID NO: 70382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattggatttgtttacgtgc

SEQ ID NO: 70383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catcttcattggatttgttt

SEQ ID NO: 70384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatcttcattggatttgtt

SEQ ID NO: 70385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccatcttcattggatttgt

SEQ ID NO: 70386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaatctttccatcttcat

SEQ ID NO: 70387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaaatctttccatcttca

SEQ ID NO: 70388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaagaatttgaaaaatctt

SEQ ID NO: 70389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaagaatttgaaaaatct

SEQ ID NO: 70390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttccaaagaatttgaaaaa

SEQ ID NO: 70391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggttgtttccaaagaattt

SEQ ID NO: 70392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggttgtttccaaagaatt

SEQ ID NO: 70393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaggttgtttccaaagaat

SEQ ID NO: 70394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaggttgtttccaaagaa

SEQ ID NO: 70395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcaggttgtttccaaaga

SEQ ID NO: 70396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcaggttgtttccaaag

SEQ ID NO: 70397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttttcaggttgtttcca

SEQ ID NO: 70398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttttcaggttgtttcc

SEQ ID NO: 70399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaccatttgtttttttcagg

SEQ ID NO: 70400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaccatttgtttttttcag

SEQ ID NO: 70401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacttagaccatttgttttt

SEQ ID NO: 70402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagaattgcacttagaccat

SEQ ID NO: 70403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtagaattgcacttagacc

SEQ ID NO: 70404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgtagaattgcacttagac

SEQ ID NO: 70405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctgtagaattgcacttag

SEQ ID NO: 70406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagcactcttctgtagaat

SEQ ID NO: 70407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagcactcttctgtagaa

SEQ ID NO: 70408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaagcactcttctgtaga

SEQ ID NO: 70409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaagcactcttctgtag

SEQ ID NO: 70410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaagcactcttctgta

SEQ ID NO: 70411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaaagcactcttctgt

SEQ ID NO: 70412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaaaagcactcttctg

SEQ ID NO: 70413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcatagattttttttaaaa

SEQ ID NO: 70414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgcatagattttttttaaa

SEQ ID NO: 70415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgcatagattttttttaa

SEQ ID NO: 70416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattttatgcatagattttt

SEQ ID NO: 70417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatattttatgcatagattt

SEQ ID NO: 70418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attctatattttatgcatag

SEQ ID NO: 70419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattctatattttatgcata

SEQ ID NO: 70420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcatttgattctatatttta

SEQ ID NO: 70421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtaaaattggcatttgattc

SEQ ID NO: 70422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgtaaaattggcatttgatt

SEQ ID NO: 70423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttcgtaaaattggcatttg

SEQ ID NO: 70424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgctgtttcgtaaaattggc

SEQ ID NO: 70425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagttatgctgtttcgtaaa

SEQ ID NO: 70426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttacagttatgctgtttcg

SEQ ID NO: 70427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggattagttacagttatgc

SEQ ID NO: 70428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggattagttacagttatg

SEQ ID NO: 70429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagatttagggattagtta

SEQ ID NO: 70430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagatttagggattagtt

SEQ ID NO: 70431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaaagatttagggattagt

SEQ ID NO: 70432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttgaaagatttagggat

SEQ ID NO: 70433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactttgaaagatttaggga

SEQ ID NO: 70434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatgcatttgactttgaa

SEQ ID NO: 70435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaatgcatttgactttga

SEQ ID NO: 70436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaatgcatttgactttg

SEQ ID NO: 70437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaaatgcatttgacttt

SEQ ID NO: 70438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaatataataatctttta

SEQ ID NO: 70439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaaatataataatctttt

SEQ ID NO: 70440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagaaaatataataatcttt

SEQ ID NO: 70441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cactttagaaaatataataa

SEQ ID NO: 70442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctacactttagaaaatataa

SEQ ID NO: 70443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactacactttagaaaata

SEQ ID NO: 70444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attactacactttagaaaat

SEQ ID NO: 70445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttattactacactttagaa

SEQ ID NO: 70446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcttattactacactttag

SEQ ID NO: 70447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgcttattactacacttta

SEQ ID NO: 70448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttctgcttattactacac

SEQ ID NO: 70449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accttctgcttattactaca

SEQ ID NO: 70450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatttaccttctgcttatta

SEQ ID NO: 70451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatttaccttctgcttatt

SEQ ID NO: 70452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagatttaccttctgcttat

SEQ ID NO: 70453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcaaagttttagatttacc

SEQ ID NO: 70454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcaaagttttagatttac

SEQ ID NO: 70455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatcaaagttttagattta

SEQ ID NO: 70456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatcaaagttttagattt

SEQ ID NO: 70457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatttttaatcaaagtttta

SEQ ID NO: 70458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatttttaatcaaagtttt

SEQ ID NO: 70459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagatttttaatcaaagttt

SEQ ID NO: 70460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttagatttttaatcaaagt

SEQ ID NO: 70461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctttagatttttaatcaaa

SEQ ID NO: 70462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctctttagatttttaatca

SEQ ID NO: 70463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctctttagatttttaatc

SEQ ID NO: 70464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctctctttagatttttaat

SEQ ID NO: 70465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaagactttctctctttag

SEQ ID NO: 70466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatcaagactttctctctt

SEQ ID NO: 70467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactgttatcaagactttct

SEQ ID NO: 70468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attacactgttatcaagact

SEQ ID NO: 70469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattacactgttatcaagac

SEQ ID NO: 70470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattacactgttatcaaga

SEQ ID NO: 70471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtggtggttttaattacac

SEQ ID NO: 70472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatgtggtggttttaatta

SEQ ID NO: 70473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actatgtggtggttttaatt

SEQ ID NO: 70474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactatgtggtggttttaat

SEQ ID NO: 70475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttactatgtggtggttttaa

SEQ ID NO: 70476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtccttttactatgtggt

SEQ ID NO: 70477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgtccttttactatgtgg

SEQ ID NO: 70478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatttaatgtccttttac

SEQ ID NO: 70479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaaattaaatatttaatgt

SEQ ID NO: 70480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagttcccaaattaaatatt

SEQ ID NO: 70481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagttcccaaattaaatat

SEQ ID NO: 70482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatatttgcagttcccaaat

SEQ ID NO: 70483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatatttgcagttcccaaa

SEQ ID NO: 70484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcaatatttgcagttccc

SEQ ID NO: 70485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataaaaagttgtttcaatat

SEQ ID NO: 70486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acctgataaaaagttgtttc

SEQ ID NO: 70487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgacctgataaaaagttgt

SEQ ID NO: 70488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgacctgataaaaagttg

SEQ ID NO: 70489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgacctgataaaaagtt

SEQ ID NO: 70490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaaatgtagtcattttgtt

SEQ ID NO: 70491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatgaaatgtagtcatttt

SEQ ID NO: 70492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattatgaaatgtagtcat

SEQ ID NO: 70493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attattatgaaatgtagtca

SEQ ID NO: 70494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatgcttattattatgaa

SEQ ID NO: 70495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatatgcttattattatga

SEQ ID NO: 70496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagatacttaaatatgctta

SEQ ID NO: 70497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggagatacttaaatatgctt

SEQ ID NO: 70498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggagatacttaaatatgct

SEQ ID NO: 70499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttggagatacttaaata

SEQ ID NO: 70500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaagtcattatctttggag

SEQ ID NO: 70501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaagtcattatctttgga

SEQ ID NO: 70502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtttacaaagtcattatct

SEQ ID NO: 70503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgttcagtttacaaagtc

SEQ ID NO: 70504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcagtgttcagtttacaaa

SEQ ID NO: 70505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctattcagtgttcagttt

SEQ ID NO: 70506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tccacccattcatctattca

SEQ ID NO: 70507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctatccacccattcatct

SEQ ID NO: 70508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcatctatccacccattc

SEQ ID NO: 70509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attcattcatctatccaccc

SEQ ID NO: 70510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actcattcattcatctatcc

SEQ ID NO: 70511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attcactcattcattcatct

SEQ ID NO: 70512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctgattcactcattcatt

SEQ ID NO: 70513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcacctgattcactcattc

SEQ ID NO: 70514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atattgttcacctgattcac

SEQ ID NO: 70515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggcagaggaacaagcattc

SEQ ID NO: 70516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcagatgtggtacagaagg

SEQ ID NO: 70517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgggcagatgtggtacag

SEQ ID NO: 70518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactgggcagatgtggtaca

SEQ ID NO: 70519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagtatggagaaaatttcac

SEQ ID NO: 70520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acagtatggagaaaatttca

SEQ ID NO: 70521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaccagaccttacagtatgg

SEQ ID NO: 70522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaccagaccttacagtatg

SEQ ID NO: 70523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatgaaaggaggtggcact

SEQ ID NO: 70524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacatgaaaggaggtggcac

SEQ ID NO: 70525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acttcacatgaaaggaggtg

SEQ ID NO: 70526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctgacttcacatgaaagga

SEQ ID NO: 70527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatctggctgacttcacatg

SEQ ID NO: 70528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtaaggggctgtatctggc

SEQ ID NO: 70529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggatgcattgagtaagggg

SEQ ID NO: 70530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtccattgaggatgcattga

SEQ ID NO: 70531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactagtccattgaggatgc

SEQ ID NO: 70532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taacacagaacaaagcaaag

SEQ ID NO: 70533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtaaatatacaaaaaatta

SEQ ID NO: 70534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggtaaatatacaaaaaatt

SEQ ID NO: 70535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caccttaggtaaatatacaa

SEQ ID NO: 70536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcaccttaggtaaatataca

SEQ ID NO: 70537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atagcttgcaccttaggtaa

SEQ ID NO: 70538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatagcttgcaccttaggt

SEQ ID NO: 70539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaacaaaaagtatacactc

SEQ ID NO: 70540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcattgacaacaaaaagta

SEQ ID NO: 70541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaggtaaagggtgattgat

SEQ ID NO: 70542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaaggtaaagggtgattga

SEQ ID NO: 70543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtacttcaaaggtaaagg

SEQ ID NO: 70544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgtacttcaaaggtaaag

SEQ ID NO: 70545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaacttcatgtacttcaaa

SEQ ID NO: 70546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtcccccaaaaaccacact

SEQ ID NO: 70547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaatattgagtcccccaaa

SEQ ID NO: 70548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccccctataaatattgagt

SEQ ID NO: 70549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggccccctataaatattgag

SEQ ID NO: 70550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggccccctataaatattga

SEQ ID NO: 70551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggccccctataaatattg

SEQ ID NO: 70552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgaaatatttttggccccc

SEQ ID NO: 70553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactcatgaaatatttttgg

SEQ ID NO: 70554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattacactcatgaaatatt

SEQ ID NO: 70555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaaattacactcatgaaat

SEQ ID NO: 70556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcctaaattacactcatgaa

SEQ ID NO: 70557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcctaaattacactcatg

SEQ ID NO: 70558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctcctaaattacactcat

SEQ ID NO: 70559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctcctaaattacactca

SEQ ID NO: 70560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctctcctaaattacactc

SEQ ID NO: 70561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taataggcatagagtttttc

SEQ ID NO: 70562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccagaattataataggcat

SEQ ID NO: 70563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcccagaattataataggc

SEQ ID NO: 70564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgcccagaattataatag

SEQ ID NO: 70565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgactctctgcccagaatta

SEQ ID NO: 70566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgactctctgcccagaat

SEQ ID NO: 70567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatgactctctgcccagaa

SEQ ID NO: 70568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctatgactctctgcccaga

SEQ ID NO: 70569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattttctatgactctctg

SEQ ID NO: 70570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcatagtagagaacacatt

SEQ ID NO: 70571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgcatagtagagaacacat

SEQ ID NO: 70572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtgcatagtagagaaca

SEQ ID NO: 70573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgtgcatagtagagaac

SEQ ID NO: 70574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttgtgcatagtagagaa

SEQ ID NO: 70575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatttgtgcatagtagaga

SEQ ID NO: 70576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttatttgtgcatagtaga

SEQ ID NO: 70577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttatttgtgcatagtag

SEQ ID NO: 70578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttcttttatttgtgcata

SEQ ID NO: 70579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcatttcttttatttgtgc

SEQ ID NO: 70580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcatttcttttatttgtg

SEQ ID NO: 70581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattcatttcttttatttgt

SEQ ID NO: 70582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacacagatattttattcat

SEQ ID NO: 70583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgaacacagatattttatt

SEQ ID NO: 70584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttactgaacacagatatt

SEQ ID NO: 70585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataaatattatgttactga

SEQ ID NO: 70586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attacataaatattatgtta

SEQ ID NO: 70587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattacataaatattatgtt

SEQ ID NO: 70588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaattacataaatattatg

SEQ ID NO: 70589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaattacataaatattat

SEQ ID NO: 70590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcttaattacataaatat

SEQ ID NO: 70591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttcttaattacataaata

SEQ ID NO: 70592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tataatcttatttcttaatt

SEQ ID NO: 70593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctgtataatcttatttctt

SEQ ID NO: 70594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacctgtataatcttatttc

SEQ ID NO: 70595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attctacctgtataatctta

SEQ ID NO: 70596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattctacctgtataatctt

SEQ ID NO: 70597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacataatacaaaggcataa

SEQ ID NO: 70598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtggctcaacataataca

SEQ ID NO: 70599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgtggctcaacataatac

SEQ ID NO: 70600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaatttcatgtggctcaac

SEQ ID NO: 70601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaaaactagaaatttcatg

SEQ ID NO: 70602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctgcaaaaactagaaatt

SEQ ID NO: 70603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatctgcaaaaactagaaat

SEQ ID NO: 70604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatctgcaaaaactagaaa

SEQ ID NO: 70605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatctgcaaaaactagaa

SEQ ID NO: 70606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatatccaaccatttttaat

SEQ ID NO: 70607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataataaaaaactaaatat

SEQ ID NO: 70608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttaaataataaaaaacta

SEQ ID NO: 70609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagttaaataataaaaaact

SEQ ID NO: 70610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagttaaataataaaaaac

SEQ ID NO: 70611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaatatatatgaaaataa

SEQ ID NO: 70612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattagaaaatatatatgaa

SEQ ID NO: 70613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaattagaaaatatatat

SEQ ID NO: 70614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgaattagaaaatatata

SEQ ID NO: 70615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttattgaattagaaaatat

SEQ ID NO: 70616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttattgaattagaaaata

SEQ ID NO: 70617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacttattgaattagaaaat

SEQ ID NO: 70618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacttattgaattagaaaa

SEQ ID NO: 70619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttacttattgaattag

SEQ ID NO: 70620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaaaaaacaaaagttaatt

SEQ ID NO: 70621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataaaattaccaaaaaaca

SEQ ID NO: 70622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaacatattgtataaaatta

SEQ ID NO: 70623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaacatattgtataaaatt

SEQ ID NO: 70624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaaacatattgtataaaat

SEQ ID NO: 70625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactttgaaacatattgtat

SEQ ID NO: 70626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatgttatactttgaaaca

SEQ ID NO: 70627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaataatatgcatcaattgt

SEQ ID NO: 70628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaataatatgcatcaattg

SEQ ID NO: 70629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcataatttggaataatat

SEQ ID NO: 70630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaggcataatttggaataa

SEQ ID NO: 70631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagatgcagttactaggca

SEQ ID NO: 70632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagagatgcagttactaggc

SEQ ID NO: 70633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagagatgcagttactagg

SEQ ID NO: 70634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttaagagatgcagttact

SEQ ID NO: 70635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattttaagagatgcagtta

SEQ ID NO: 70636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattttaagagatgcagtt

SEQ ID NO: 70637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctattttaagagatgcagt

SEQ ID NO: 70638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggatggtaattttctatt

SEQ ID NO: 70639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaaaatgtcaaaagaattg

SEQ ID NO: 70640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaaaatgtcaaaagaatt

SEQ ID NO: 70641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgaaaatgtcaaaagaat

SEQ ID NO: 70642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttatgaaaatgtcaaaag

SEQ ID NO: 70643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcctttatgaaaatgtcaa

SEQ ID NO: 70644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattcctttatgaaaatgt

SEQ ID NO: 70645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattcctttatgaaaa

SEQ ID NO: 70646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attattattattcctttatg

SEQ ID NO: 70647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaattattattattccttt

SEQ ID NO: 70648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctactaattattattattcc

SEQ ID NO: 70649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgctactaattattattat

SEQ ID NO: 70650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctactgctactaattattat

SEQ ID NO: 70651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caatattactactgctacta

SEQ ID NO: 70652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccaatattactactgctac

SEQ ID NO: 70653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctccaatattactactgcta

SEQ ID NO: 70654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaaggtcaggcatgcttct

SEQ ID NO: 70655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaggtattaacaaggtcag

SEQ ID NO: 70656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaaggtattaacaaggtca

SEQ ID NO: 70657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaagataccttggaaggta

SEQ ID NO: 70658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtaagataccttggaaggt

SEQ ID NO: 70659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttggtaagataccttggaag

SEQ ID NO: 70660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttggtaagataccttgga

SEQ ID NO: 70661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gattctcttggtaagatacc

SEQ ID NO: 70662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aataaaatctggattctctt

SEQ ID NO: 70663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccctgaataaaatctggatt

SEQ ID NO: 70664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaccctgaataaaatctgg

SEQ ID NO: 70665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcatattgctaccctgaat

SEQ ID NO: 70666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgggcatattgctaccct

SEQ ID NO: 70667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctgggcatattgctaccc

SEQ ID NO: 70668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcaggacatttatctggg

SEQ ID NO: 70669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctgaggcaggacatttatc

SEQ ID NO: 70670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acaacaaggtagcctggctg

SEQ ID NO: 70671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaagaacagtgtgacatgg

SEQ ID NO: 70672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggcaagaacagtgtgaca

SEQ ID NO: 70673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attggcaagaacagtgtgac

SEQ ID NO: 70674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtcttattggcaagaacag

SEQ ID NO: 70675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgtcttattggcaagaaca

SEQ ID NO: 70676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcttatgtcttattggcaag

SEQ ID NO: 70677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcttatgtcttattggcaa

SEQ ID NO: 70678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggcttatgtcttattggca

SEQ ID NO: 70679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccaactttggcttatgtct

SEQ ID NO: 70680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atccaactttggcttatgtc

SEQ ID NO: 70681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagagatccttatccaact

SEQ ID NO: 70682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccagagatccttatccaac

SEQ ID NO: 70683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcccagagatccttatccaa

SEQ ID NO: 70684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggaagggcaaaactttccc

SEQ ID NO: 70685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctgaggaagggcaaaactt

SEQ ID NO: 70686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcctgaggaagggcaaaact

SEQ ID NO: 70687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcccacttgcctgaggaagg

SEQ ID NO: 70688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatccaatacccaggtagag

SEQ ID NO: 70689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatccaatacccaggtaga

SEQ ID NO: 70690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatatccaatacccaggtag

SEQ ID NO: 70691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagctttatatccaataccc

SEQ ID NO: 70692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacctacagctttatatcca

SEQ ID NO: 70693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttccacctacagctttatat

SEQ ID NO: 70694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaggtgactgttccacctac

SEQ ID NO: 70695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgattagaggtgactgttcc

SEQ ID NO: 70696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgcctatgattagaggtga

SEQ ID NO: 70697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattaatgcctatgattaga

SEQ ID NO: 70698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatattaatgcctatgatta

SEQ ID NO: 70699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatattaatgcctatgatt

SEQ ID NO: 70700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctatattaatgcctatga

SEQ ID NO: 70701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctatattaatgcctatg

SEQ ID NO: 70702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttctatattaatgcctat

SEQ ID NO: 70703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttctatattaatgccta

SEQ ID NO: 70704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttctatattaatgcct

SEQ ID NO: 70705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatgtgttttttcttctat

SEQ ID NO: 70706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacatgtgttttttcttcta

SEQ ID NO: 70707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaatcttcacatgtgtttt

SEQ ID NO: 70708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgccaatcttcacatgtgtt

SEQ ID NO: 70709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgccaatcttcacatgtgt

SEQ ID NO: 70710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccttctgccaatcttcacat

SEQ ID NO: 70711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccttctgccaatcttcac

SEQ ID NO: 70712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcccttctgccaatcttca

SEQ ID NO: 70713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctcccttctgccaatctt

SEQ ID NO: 70714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catctcttctcccttctgcc

SEQ ID NO: 70715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggctccatctcttctccctt

SEQ ID NO: 70716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgtcctaggctccatctc

SEQ ID NO: 70717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacatccacagatcagcag

SEQ ID NO: 70718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacatccacagatcagca

SEQ ID NO: 70719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaacatccacagatcagc

SEQ ID NO: 70720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atattttaaaacatccacag

SEQ ID NO: 70721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catattttaaaacatccaca

SEQ ID NO: 70722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatattttaaaacatccac

SEQ ID NO: 70723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttcatattttaaaacatc

SEQ ID NO: 70724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttttcatattttaaaaca

SEQ ID NO: 70725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatagaacattctgttttca

SEQ ID NO: 70726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcataactggatagaacatt

SEQ ID NO: 70727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattggcataactggataga

SEQ ID NO: 70728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actacattggcataactgga

SEQ ID NO: 70729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aactacattggcataactgg

SEQ ID NO: 70730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catgcaacagagacttaact

SEQ ID NO: 70731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actgcatgcaacagagactt

SEQ ID NO: 70732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactgcatgcaacagagact

SEQ ID NO: 70733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttaactgcatgcaacagag

SEQ ID NO: 70734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtttaactgcatgcaacag

SEQ ID NO: 70735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtcaggactctgtttaact

SEQ ID NO: 70736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagtcaggactctgtttaa

SEQ ID NO: 70737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgagtcaggactctgttta

SEQ ID NO: 70738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctgagtcaggactctgt

SEQ ID NO: 70739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctatttctgagtcaggact

SEQ ID NO: 70740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctatttctgagtcaggac

SEQ ID NO: 70741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggctatttctgagtcagga

SEQ ID NO: 70742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggctatttctgagtcagg

SEQ ID NO: 70743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttggctatttctgagtc

SEQ ID NO: 70744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatttttggctatttctga

SEQ ID NO: 70745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttatttttggctatttctg

SEQ ID NO: 70746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttatttttggctatttct

SEQ ID NO: 70747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgtgtgttttgttatttt

SEQ ID NO: 70748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtgtgtgttttgttattt

SEQ ID NO: 70749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtgtgtgttttgttatt

SEQ ID NO: 70750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgtgtgtgttttgttat

SEQ ID NO: 70751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtgtgtgtgttttgtta

SEQ ID NO: 70752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgtgtgtgtgttttgtt

SEQ ID NO: 70753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttttttgtgtgtgtgtttt

SEQ ID NO: 70754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agggtacatgggtaatccct

SEQ ID NO: 70755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagggtacatgggtaatccc

SEQ ID NO: 70756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttaagggtacatgggtaat

SEQ ID NO: 70757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttaagggtacatgggtaa

SEQ ID NO: 70758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacttaagggtacatgggta

SEQ ID NO: 70759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttacttaagggtacatgg

SEQ ID NO: 70760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aataaacctattttacttaa

SEQ ID NO: 70761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaataaacctattttactta

SEQ ID NO: 70762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgaataaacctattttac

SEQ ID NO: 70763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actatttgaataaacctatt

SEQ ID NO: 70764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aactatttgaataaacctat

SEQ ID NO: 70765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agatcttaactatttgaata

SEQ ID NO: 70766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccacaccaaggtacacatgt

SEQ ID NO: 70767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgccacaccaaggtacaca

SEQ ID NO: 70768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgccacaccaaggtacac

SEQ ID NO: 70769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggagtacacttactgccac

SEQ ID NO: 70770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggggctagggagtacactta

SEQ ID NO: 70771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattaggggctagggagtac

SEQ ID NO: 70772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggctatattaggggctagg

SEQ ID NO: 70773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acattaaggctatattaggg

SEQ ID NO: 70774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacattaaggctatattagg

SEQ ID NO: 70775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcacattaaggctatattag

SEQ ID NO: 70776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttcacattaaggctata

SEQ ID NO: 70777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattatctttcacattaagg

SEQ ID NO: 70778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatattatctttcacatta

SEQ ID NO: 70779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattatattatctttcaca

SEQ ID NO: 70780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attattatattatctttcac

SEQ ID NO: 70781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttattattatattatctt

SEQ ID NO: 70782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtagaattgatttattatt

SEQ ID NO: 70783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggacaatgtattaagtaga

SEQ ID NO: 70784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaggacaatgtattaagta

SEQ ID NO: 70785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcaggacaatgtattaag

SEQ ID NO: 70786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttctctcaggacaatgta

SEQ ID NO: 70787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgttctctcaggacaatgt

SEQ ID NO: 70788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgttctctcaggacaatg

SEQ ID NO: 70789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacctttgtgttctctcagg

SEQ ID NO: 70790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaacctttgtgttctctcag

SEQ ID NO: 70791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaacctttgtgttctctca

SEQ ID NO: 70792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgaacctttgtgttctct

SEQ ID NO: 70793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctttgaacctttgtgttct

SEQ ID NO: 70794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctctttgaacctttgtgt

SEQ ID NO: 70795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctctctttgaacctttgtg

SEQ ID NO: 70796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctctctttgaacctttgt

SEQ ID NO: 70797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacatcactttgctctcttt

SEQ ID NO: 70798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacacatcactttgctctct

SEQ ID NO: 70799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacacatcactttgctctc

SEQ ID NO: 70800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctacacatcactttgctct

SEQ ID NO: 70801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctacacatcactttgctc

SEQ ID NO: 70802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctacacatcactttgct

SEQ ID NO: 70803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcataattttttctacacat

SEQ ID NO: 70804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcataattttttctacaca

SEQ ID NO: 70805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcaatttggcataatttt

SEQ ID NO: 70806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagaaaagtattaaatcaat

SEQ ID NO: 70807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacagaaaagtattaaatc

SEQ ID NO: 70808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttattacagaaaagtatt

SEQ ID NO: 70809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatgttattacagaaaagt

SEQ ID NO: 70810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attatgttattacagaaaag

SEQ ID NO: 70811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatgacttattatgttatt

SEQ ID NO: 70812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcatgacttattatgttat

SEQ ID NO: 70813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtcatgacttattatgtta

SEQ ID NO: 70814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctttgtcatgacttattatg

SEQ ID NO: 70815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagcatctcctttgtcatga

SEQ ID NO: 70816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagcatctcctttgtcatg

SEQ ID NO: 70817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaagcatctcctttgtcat

SEQ ID NO: 70818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctttaaagcatctcctttg

SEQ ID NO: 70819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagtccagatcattgccttt

SEQ ID NO: 70820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaaatatcactaaagtcca

SEQ ID NO: 70821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaagtgactcagaaatatc

SEQ ID NO: 70822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgaaattggcaagtgactc

SEQ ID NO: 70823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgatgaaattggcaagtga

SEQ ID NO: 70824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttgatgaaattggcaagtg

SEQ ID NO: 70825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttgttgatgaaattggca

SEQ ID NO: 70826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctggcttgttgatgaaatt

SEQ ID NO: 70827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccctggcttgttgatgaaa

SEQ ID NO: 70828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccagctctccctggcttgt

SEQ ID NO: 70829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atccagctctccctggcttg

SEQ ID NO: 70830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agacttatccagctctccct

SEQ ID NO: 70831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaagacttatccagctctc

SEQ ID NO: 70832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgctactaagacttatcca

SEQ ID NO: 70833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtgctactaagacttatcc

SEQ ID NO: 70834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagtgctactaagacttat

SEQ ID NO: 70835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaggttcttagtgctacta

SEQ ID NO: 70836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtaactatgaggttctta

SEQ ID NO: 70837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgaggtaactatgaggttc

SEQ ID NO: 70838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgaggtaactatgaggtt

SEQ ID NO: 70839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtgaaaaccttgctgaggt

SEQ ID NO: 70840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taggtgaaaaccttgctgag

SEQ ID NO: 70841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaggtgaaaaccttgctg

SEQ ID NO: 70842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctaggtgaaaaccttgct

SEQ ID NO: 70843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctctaggtgaaaaccttg

SEQ ID NO: 70844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcttctctaggtgaaaac

SEQ ID NO: 70845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atacattcattcttctctag

SEQ ID NO: 70846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctgatacattcattcttct

SEQ ID NO: 70847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcctgatacattcattctt

SEQ ID NO: 70848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgcctgatacattcattct

SEQ ID NO: 70849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagcttctgcctgatacatt

SEQ ID NO: 70850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtagcttctgcctgatacat

SEQ ID NO: 70851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtagcttctgcctgatac

SEQ ID NO: 70852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagttcttgtagcttctgcc

SEQ ID NO: 70853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaccaaattcaagttcttgt

SEQ ID NO: 70854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctagaccaaattcaagtt

SEQ ID NO: 70855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataaatatgacaaactcatc

SEQ ID NO: 70856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgataaatatgacaaactc

SEQ ID NO: 70857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgcaaattattgataaata

SEQ ID NO: 70858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgcaaattattgataaat

SEQ ID NO: 70859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgcaaattattgataaa

SEQ ID NO: 70860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatgcaaattattgataa

SEQ ID NO: 70861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcatgcaaattattgata

SEQ ID NO: 70862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttttcatgcaaattattg

SEQ ID NO: 70863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtgtctattttttcatgc

SEQ ID NO: 70864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catatattaatgtgtctatt

SEQ ID NO: 70865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatatattaatgtgtctat

SEQ ID NO: 70866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcatatattaatgtgtcta

SEQ ID NO: 70867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcatatattaatgtgtct

SEQ ID NO: 70868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttgcatatattaatgtg

SEQ ID NO: 70869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttgcatatattaatgt

SEQ ID NO: 70870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatatttatttttgcatata

SEQ ID NO: 70871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtgtatctgtatatttat

SEQ ID NO: 70872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgtgtatctgtatattta

SEQ ID NO: 70873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtatttcatgtgtatctg

SEQ ID NO: 70874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacattatggtatttcatgt

SEQ ID NO: 70875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacattatggtatttcatg

SEQ ID NO: 70876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatacattatggtatttcat

SEQ ID NO: 70877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgcatattttatacatta

SEQ ID NO: 70878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtattaaatgcatatttta

SEQ ID NO: 70879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcagtattaaatgcatatt

SEQ ID NO: 70880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcagtattaaatgcatat

SEQ ID NO: 70881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttattcagtattaaatg

SEQ ID NO: 70882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatttattcagtattaaat

SEQ ID NO: 70883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccatttattcagtattaaa

SEQ ID NO: 70884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttccatttattcagtatt

SEQ ID NO: 70885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttccatttattcagtat

SEQ ID NO: 70886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctttccatttattcagta

SEQ ID NO: 70887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cataaccctttcctttccat

SEQ ID NO: 70888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagactacataaccctttcc

SEQ ID NO: 70889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaagactacataacccttt

SEQ ID NO: 70890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaagactacataaccctt

SEQ ID NO: 70891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcaagactacataaccct

SEQ ID NO: 70892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctcaagactacataacc

SEQ ID NO: 70893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttctcaagactacataac

SEQ ID NO: 70894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaatatatttctttctcaag

SEQ ID NO: 70895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagaatatatttctttctca

SEQ ID NO: 70896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctagaatatatttctttctc

SEQ ID NO: 70897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttctagaatatatttcttt

SEQ ID NO: 70898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttctagaatatatttctt

SEQ ID NO: 70899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacttctagaatatatttct

SEQ ID NO: 70900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attttacttctagaatatat

SEQ ID NO: 70901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaagtaaaactgattttac

SEQ ID NO: 70902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaaaagtaaaactgattt

SEQ ID NO: 70903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgaaaagtaaaactgatt

SEQ ID NO: 70904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattgaaaagtaaaactgat

SEQ ID NO: 70905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttattgaaaagtaaaactg

SEQ ID NO: 70906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttattgaaaagtaaaact

SEQ ID NO: 70907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttctttattgaaaagtaa

SEQ ID NO: 70908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcccttctttattgaaaag

SEQ ID NO: 70909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcccttctttattgaaaa

SEQ ID NO: 70910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcttattcccttctttattg

SEQ ID NO: 70911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaactatcttattcccttc

SEQ ID NO: 70912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaaactatcttattccctt

SEQ ID NO: 70913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcaaaactatcttattccc

SEQ ID NO: 70914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcaaaactatcttattcc

SEQ ID NO: 70915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcttcaaaactatcttat

SEQ ID NO: 70916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttcttcaaaactatctta

SEQ ID NO: 70917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttgtttcttcaaaacta

SEQ ID NO: 70918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatttgtttcttcaaaact

SEQ ID NO: 70919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtgtttaaatttgtttctt

SEQ ID NO: 70920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtgtttaaatttgtttct

SEQ ID NO: 70921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggtgtttaaatttgtttc

SEQ ID NO: 70922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattttaggtgtttaaattt

SEQ ID NO: 70923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattttaggtgtttaaatt

SEQ ID NO: 70924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatattttaggtgtttaaat

SEQ ID NO: 70925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatattttaggtgtttaaa

SEQ ID NO: 70926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaataatgtgtgattttta

SEQ ID NO: 70927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtaataatgtgtgattttt

SEQ ID NO: 70928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccttggtaataatgtgtgat

SEQ ID NO: 70929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtctaccttggtaataat

SEQ ID NO: 70930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggttatagtctaccttggta

SEQ ID NO: 70931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attaggttatagtctacctt

SEQ ID NO: 70932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actgattaggttatagtcta

SEQ ID NO: 70933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgctgactgattaggttat

SEQ ID NO: 70934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatgctgactgattaggtta

SEQ ID NO: 70935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atccaccttaatgctgactg

SEQ ID NO: 70936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatccaccttaatgctgac

SEQ ID NO: 70937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaatccaccttaatgctga

SEQ ID NO: 70938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcttctaatccaccttaat

SEQ ID NO: 70939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atattgtgcttctaatccac

SEQ ID NO: 70940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatattgtgcttctaatcc

SEQ ID NO: 70941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggattctgatattgtgcttc

SEQ ID NO: 70942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgggattctgatattgtg

SEQ ID NO: 70943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attcattgggattctgatat

SEQ ID NO: 70944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgattcattgggattctga

SEQ ID NO: 70945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgattcattgggattctg

SEQ ID NO: 70946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacatttgctgattcattgg

SEQ ID NO: 70947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatggtattgtacatttgc

SEQ ID NO: 70948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgtaatggtattgtacatt

SEQ ID NO: 70949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttgtaatggtattgtaca

SEQ ID NO: 70950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgttgtaatggtattgtac

SEQ ID NO: 70951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgttgtaatggtattgta

SEQ ID NO: 70952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agggtgaaattttctgttgt

SEQ ID NO: 70953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatggtgtaattcagggtg

SEQ ID NO: 70954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtaatggtgtaattcaggg

SEQ ID NO: 70955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacctctgtaatggtgtaat

SEQ ID NO: 70956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctatacctctgtaatggtgt

SEQ ID NO: 70957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgctatacctctgtaatggt

SEQ ID NO: 70958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgctatacctctgtaatgg

SEQ ID NO: 70959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgctatacctctgtaatg

SEQ ID NO: 70960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttctgctatacctctgta

SEQ ID NO: 70961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgccatagaaaggcaaga

SEQ ID NO: 70962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactacatgccatagaaagg

SEQ ID NO: 70963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatcattatactacatgcc

SEQ ID NO: 70964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaccccaagctgtaatcatt

SEQ ID NO: 70965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaccccaagctgtaatcat

SEQ ID NO: 70966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttaaaccccaagctgta

SEQ ID NO: 70967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatttaaaccccaagctgt

SEQ ID NO: 70968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatttaaaccccaagctg

SEQ ID NO: 70969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatttaaaccccaagct

SEQ ID NO: 70970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaaatttaaaccccaagc

SEQ ID NO: 70971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggggtctttttaaatttaaa

SEQ ID NO: 70972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcatggacgtatctggggg

SEQ ID NO: 70973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttagtcatggacgtatctg

SEQ ID NO: 70974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttagtcatggacgtatct

SEQ ID NO: 70975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaaagatttggttagtca

SEQ ID NO: 70976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagattaagaaaagatttg

SEQ ID NO: 70977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaagattaagaaaagatt

SEQ ID NO: 70978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgattctaaaagattaagaa

SEQ ID NO: 70979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagatgactgcgattctaaa

SEQ ID NO: 70980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagatgactgcgattctaa

SEQ ID NO: 70981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatttgcagatgactgcgat

SEQ ID NO: 70982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaagtaaatataatgcatc

SEQ ID NO: 70983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggaagtaaatataatgcat

SEQ ID NO: 70984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttaggaagtaaatataatg

SEQ ID NO: 70985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgacctccttaggaagtaaa

SEQ ID NO: 70986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgacctccttaggaagtaa

SEQ ID NO: 70987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgacctccttaggaagta

SEQ ID NO: 70988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtctttgtgacctccttagg

SEQ ID NO: 70989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgtctttgtgacctccttag

SEQ ID NO: 70990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgtctttgtgacctcctta

SEQ ID NO: 70991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataattttcgtctttgtga

SEQ ID NO: 70992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacacattatataattttcg

SEQ ID NO: 70993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acacacattatataattttc

SEQ ID NO: 70994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacacacattatataatttt

SEQ ID NO: 70995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaggtggatgcaaaagaag

SEQ ID NO: 70996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaggtggatgcaaaagaa

SEQ ID NO: 70997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaacagcggatcaaacaca

SEQ ID NO: 70998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgacagaaccacagacagc

SEQ ID NO: 70999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgacagaaccacagacag

SEQ ID NO: 71000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttcatgacagaaccacaga

SEQ ID NO: 71001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagcatctacttcatgacag

SEQ ID NO: 71002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agagcatctacttcatgaca

SEQ ID NO: 71003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaagcaggatgtggacagt

SEQ ID NO: 71004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctggaaagcaggatgtggac

SEQ ID NO: 71005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctggaaagcaggatgtgga

SEQ ID NO: 71006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggggaatgagcagcttgctg

SEQ ID NO: 71007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcagctgggggaatgagcag

SEQ ID NO: 71008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcagctgggggaatgagca

SEQ ID NO: 71009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggcagctgggggaatgagc

SEQ ID NO: 71010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggcagctgggggaatgag

SEQ ID NO: 71011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcatccaacacttttggca

SEQ ID NO: 71012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagcatccaacacttttggc

SEQ ID NO: 71013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatgtgagccttcagcatc

SEQ ID NO: 71014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccacgataaggcccaaagag

SEQ ID NO: 71015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgccacgataaggcccaaag

SEQ ID NO: 71016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgccacgataaggcccaaa

SEQ ID NO: 71017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccttctgccacgataaggcc

SEQ ID NO: 71018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggggaagcacctcccttctg

SEQ ID NO: 71019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggggaagcacctcccttct

SEQ ID NO: 71020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caggggagaagggtataacc

SEQ ID NO: 71021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaggggagaagggtataac

SEQ ID NO: 71022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccaggggagaagggtataa

SEQ ID NO: 71023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctttccaggggagaagggt

SEQ ID NO: 71024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctttccaggggagaaggg

SEQ ID NO: 71025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacctttccaggggagaagg

SEQ ID NO: 71026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctttacctttccaggggag

SEQ ID NO: 71027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccctttacctttccagggg

SEQ ID NO: 71028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgcaggctctccctttac

SEQ ID NO: 71029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggatgcaggctctccct

SEQ ID NO: 71030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacaccattcattggatgca

SEQ ID NO: 71031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccacaccattcattggatg

SEQ ID NO: 71032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctccacaccattcattggat

SEQ ID NO: 71033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctccacaccattcattgg

SEQ ID NO: 71034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctccacaccattcattg

SEQ ID NO: 71035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttctccacaccattcatt

SEQ ID NO: 71036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaacaaagcaagagggtc

SEQ ID NO: 71037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtagttccaaaacaaagc

SEQ ID NO: 71038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggagtagttccaaaacaaa

SEQ ID NO: 71039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgacaaccctctggagtagt

SEQ ID NO: 71040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgctgtgacaaccctctgg

SEQ ID NO: 71041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatgctgtgacaaccctct

SEQ ID NO: 71042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcatctctgatgctgtgaca

SEQ ID NO: 71043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttggcatctctgatgctgtg

SEQ ID NO: 71044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcctattggcatctctgat

SEQ ID NO: 71045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggctgatcctattggcatct

SEQ ID NO: 71046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cggctgatcctattggcatc

SEQ ID NO: 71047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caacagagatttcggctgat

SEQ ID NO: 71048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattgcaacagagatttcg

SEQ ID NO: 71049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaaaattgcaacagagatt

SEQ ID NO: 71050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactgttaaaattgcaacag

SEQ ID NO: 71051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggcagagagagaagttgaac

SEQ ID NO: 71052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgggcagagagagaagttg

SEQ ID NO: 71053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaaaagtgaggcatgcaaa

SEQ ID NO: 71054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggaacgaaacgtaacatct

SEQ ID NO: 71055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggaacgaaacgtaacatc

SEQ ID NO: 71056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaggaacgaaacgtaacat

SEQ ID NO: 71057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaagtgttttcaggaacga

SEQ ID NO: 71058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgagaagtgttttcaggaa

SEQ ID NO: 71059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgagaagtgttttcagga

SEQ ID NO: 71060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatttactgagaagtgttt

SEQ ID NO: 71061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agagagaaatctgagattta

SEQ ID NO: 71062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaaaccaatcctgagagag

SEQ ID NO: 71063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgggaaaccaatcctgag

SEQ ID NO: 71064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtaggggtcagttccctgg

SEQ ID NO: 71065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcacgggattgtgtagggg

SEQ ID NO: 71066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaatcacgggattgtgta

SEQ ID NO: 71067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattaatcacgggattgtgt

SEQ ID NO: 71068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcattaatcacgggattgtg

SEQ ID NO: 71069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actttcattaatcacgggat

SEQ ID NO: 71070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatgctaactttcattaatc

SEQ ID NO: 71071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatgctaactttcattaat

SEQ ID NO: 71072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatgctaactttcattaa

SEQ ID NO: 71073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggattttgtatgctaacttt

SEQ ID NO: 71074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagataggttgggattttgt

SEQ ID NO: 71075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggaaagaagaaaagtcaga

SEQ ID NO: 71076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaggaaagaagaaaagtcag

SEQ ID NO: 71077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacaggaggtatatggaaag

SEQ ID NO: 71078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtacaggcagtgaacctg

SEQ ID NO: 71079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcagtacaggcagtgaacct

SEQ ID NO: 71080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgcagtacaggcagtgaa

SEQ ID NO: 71081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactacttgcagtacaggca

SEQ ID NO: 71082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaactacttgcagtacaggc

SEQ ID NO: 71083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtggcatcataaatttgaac

SEQ ID NO: 71084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtggcatcataaatttgaa

SEQ ID NO: 71085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttggtggcatcataaatt

SEQ ID NO: 71086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttggtggcatcataaat

SEQ ID NO: 71087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaggtaggggaaatacag

SEQ ID NO: 71088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggaggagaaaattgagga

SEQ ID NO: 71089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaatacactgatggaggag

SEQ ID NO: 71090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atacaattaagaatacactg

SEQ ID NO: 71091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgatacaattaagaataca

SEQ ID NO: 71092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatggttattgatacaatta

SEQ ID NO: 71093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagactagatggttattga

SEQ ID NO: 71094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaagactagatggttattg

SEQ ID NO: 71095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acttagaagactagatggtt

SEQ ID NO: 71096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacttagaagactagatggt

SEQ ID NO: 71097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacttagaagactagatgg

SEQ ID NO: 71098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacccacaacaaagaatttt

SEQ ID NO: 71099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caattcaacccacaacaaag

SEQ ID NO: 71100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaggattacaattcaaccca

SEQ ID NO: 71101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaggattacaattcaaccc

SEQ ID NO: 71102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaggattacaattcaacc

SEQ ID NO: 71103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggaggattacaattcaac

SEQ ID NO: 71104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacataacttttggaggatt

SEQ ID NO: 71105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caacataacttttggaggat

SEQ ID NO: 71106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggacttcaacataacttttg

SEQ ID NO: 71107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaacatgccagggttaggac

SEQ ID NO: 71108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaataagatcacactcaaa

SEQ ID NO: 71109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaataagatcacactcaa

SEQ ID NO: 71110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaagaccatatttccaaat

SEQ ID NO: 71111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtctgcaaagaccatattt

SEQ ID NO: 71112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgtgtctgcaaagaccat

SEQ ID NO: 71113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattgtgtctgcaaagacca

SEQ ID NO: 71114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcttcattgtgtctgcaaa

SEQ ID NO: 71115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacccacacaatgacctcat

SEQ ID NO: 71116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggacccacacaatgacctca

SEQ ID NO: 71117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatttggacccacacaatga

SEQ ID NO: 71118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattggatttggacccacac

SEQ ID NO: 71119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaggaccccagttatattg

SEQ ID NO: 71120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataaggaccccagttatatt

SEQ ID NO: 71121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttataaggaccccagttata

SEQ ID NO: 71122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttataaggaccccagttat

SEQ ID NO: 71123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttataaggaccccagtt

SEQ ID NO: 71124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcttataaggaccccagt

SEQ ID NO: 71125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttcttataaggaccccag

SEQ ID NO: 71126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttcttataaggacccca

SEQ ID NO: 71127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggtcttttcttcttataagg

SEQ ID NO: 71128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgtctcggtcttttcttc

SEQ ID NO: 71129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctgtgtgtctcggtctttt

SEQ ID NO: 71130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccctgtgtgtctcggtctt

SEQ ID NO: 71131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccctgtgtgtctcggtct

SEQ ID NO: 71132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctccctgtgtgtctcggtc

SEQ ID NO: 71133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acgtagttttctccctgtgt

SEQ ID NO: 71134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcccggtactcacgtagttt

SEQ ID NO: 71135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggcccggtactcacgtagt

SEQ ID NO: 71136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catcatcccaatctctggcc

SEQ ID NO: 71137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagctgcatcatcccaatct

SEQ ID NO: 71138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcagctgcatcatcccaatc

SEQ ID NO: 71139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagcttgcagctgcatcatc

SEQ ID NO: 71140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcagcttgcagctgcatcat

SEQ ID NO: 71141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaatccttgcagcttgcag

SEQ ID NO: 71142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttggcaatccttgcagcttg

SEQ ID NO: 71143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaggttgttggcaatccttg

SEQ ID NO: 71144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaggttgttggcaatcctt

SEQ ID NO: 71145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggaggttgttggcaatcct

SEQ ID NO: 71146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actttggaggttgttggcaa

SEQ ID NO: 71147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taactttggaggttgttggc

SEQ ID NO: 71148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaactttggaggttgttgg

SEQ ID NO: 71149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctaactttggaggttgttg

SEQ ID NO: 71150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttctaactttggaggttg

SEQ ID NO: 71151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgctttctaactttggagg

SEQ ID NO: 71152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgctttctaactttggag

SEQ ID NO: 71153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccttgctgctttctaacttt

SEQ ID NO: 71154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtaagtatcctgccttgctg

SEQ ID NO: 71155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagtaagtatcctgccttgc

SEQ ID NO: 71156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaggctctagtaagtatcct

SEQ ID NO: 71157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaaggctctagtaagtatc

SEQ ID NO: 71158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaaaggctctagtaagta

SEQ ID NO: 71159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctaaaggctctagtaagt

SEQ ID NO: 71160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcaaggccatgatttctct

SEQ ID NO: 71161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatcaaggtctgagcaagg

SEQ ID NO: 71162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaagtctgaaatcaaggtct

SEQ ID NO: 71163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaggctagaagtctgaaatc

SEQ ID NO: 71164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaggctagaagtctgaaa

SEQ ID NO: 71165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccagttctggaggctagaag

SEQ ID NO: 71166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccagttctggaggctagaa

SEQ ID NO: 71167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgccagttctggaggctaga

SEQ ID NO: 71168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgccagttctggaggctag

SEQ ID NO: 71169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgccagttctggaggct

SEQ ID NO: 71170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttttgccagttctggag

SEQ ID NO: 71171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcttttgccagttctgga

SEQ ID NO: 71172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caacaacagaaatttattct

SEQ ID NO: 71173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaacaacagaaatttattc

SEQ ID NO: 71174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtggcttacaacaacagaa

SEQ ID NO: 71175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaaaactcagtggcttaca

SEQ ID NO: 71176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taacaaattagcaaaactca

SEQ ID NO: 71177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgtaacaaattagcaaaac

SEQ ID NO: 71178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cggctgttgtaacaaattag

SEQ ID NO: 71179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acggctgttgtaacaaatta

SEQ ID NO: 71180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacggctgttgtaacaaat

SEQ ID NO: 71181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttacggctgttgtaacaaa

SEQ ID NO: 71182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttcttacggctgttgtaa

SEQ ID NO: 71183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atccaaggatgtattagttt

SEQ ID NO: 71184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagctgatccaaggatgta

SEQ ID NO: 71185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatatataagattgtgagct

SEQ ID NO: 71186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agggtctagatatataagat

SEQ ID NO: 71187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatataagggctcagggtc

SEQ ID NO: 71188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagttaaaatataagggct

SEQ ID NO: 71189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaagttaaaatataagggc

SEQ ID NO: 71190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttgaaagttaaaatataa

SEQ ID NO: 71191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatcgggattaacttgaaa

SEQ ID NO: 71192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatatcgggattaacttgaa

SEQ ID NO: 71193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caacaatttaatatcgggat

SEQ ID NO: 71194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acacagctgcaacaatttaa

SEQ ID NO: 71195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcacacagctgcaacaattt

SEQ ID NO: 71196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agggaaaaaagatcatgttc

SEQ ID NO: 71197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgagggaaaaaagatcatg

SEQ ID NO: 71198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaattgctgagggaaaaaa

SEQ ID NO: 71199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgctaagaattgctgaggga

SEQ ID NO: 71200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcactgtgctaagaattgc

SEQ ID NO: 71201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagcactgtgctaagaatt

SEQ ID NO: 71202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgctctaagcactgtgctaa

SEQ ID NO: 71203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatgctctaagcactgtgc

SEQ ID NO: 71204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actatgctctaagcactgtg

SEQ ID NO: 71205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caccttactatgctctaagc

SEQ ID NO: 71206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacaccttactatgctcta

SEQ ID NO: 71207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attacaccttactatgctct

SEQ ID NO: 71208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaataaatatttattacac

SEQ ID NO: 71209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcaataaatatttattaca

SEQ ID NO: 71210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggaagtatgaaatgcacc

SEQ ID NO: 71211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaggaagtatgaaatgcac

SEQ ID NO: 71212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagccttaaaggaagtatg

SEQ ID NO: 71213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attagaagccttaaaggaag

SEQ ID NO: 71214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcattagaagccttaaagg

SEQ ID NO: 71215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctcattagaagccttaaag

SEQ ID NO: 71216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcagtgaagtgcttcctcat

SEQ ID NO: 71217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccactggcagtgaagtgctt

SEQ ID NO: 71218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accactggcagtgaagtgct

SEQ ID NO: 71219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taccactggcagtgaagtgc

SEQ ID NO: 71220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaccactggcagtgaagtg

SEQ ID NO: 71221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaccactggcagtgaagt

SEQ ID NO: 71222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttaccactggcagtgaag

SEQ ID NO: 71223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacaggcttttttaccactg

SEQ ID NO: 71224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaacacactacacaggctt

SEQ ID NO: 71225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaacattaacaacacacta

SEQ ID NO: 71226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caagcacactccaaacatta

SEQ ID NO: 71227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagtgcaatgaagccctcca

SEQ ID NO: 71228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgaagtgcaatgaagccct

SEQ ID NO: 71229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctgaagtgcaatgaagcc

SEQ ID NO: 71230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcctgaagtgcaatgaagc

SEQ ID NO: 71231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagtcagccttctcctgaa

SEQ ID NO: 71232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagagtcagccttctcctg

SEQ ID NO: 71233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcagagtcagccttctcct

SEQ ID NO: 71234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctcagagtcagccttctc

SEQ ID NO: 71235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggctcttctcagagtcag

SEQ ID NO: 71236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aactgatggctcttctcaga

SEQ ID NO: 71237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaatgcaggcactgaactg

SEQ ID NO: 71238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagaatgcaggcactgaac

SEQ ID NO: 71239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaagaatgcaggcactgaa

SEQ ID NO: 71240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttctaagaatgcaggcact

SEQ ID NO: 71241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgtttctaagaatgcagg

SEQ ID NO: 71242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactgtttctaagaatgcag

SEQ ID NO: 71243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcactgtttctaagaatgca

SEQ ID NO: 71244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcactgtttctaagaatgc

SEQ ID NO: 71245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttcactgtttctaagaat

SEQ ID NO: 71246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaggtacccatgagaataa

SEQ ID NO: 71247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctcaaaggtacccatgaga

SEQ ID NO: 71248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatctcaaaggtacccatg

SEQ ID NO: 71249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagagatagtcagtgtcaga

SEQ ID NO: 71250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaagagatagtcagtgtca

SEQ ID NO: 71251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgaagagatagtcagtgt

SEQ ID NO: 71252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctgaagagatagtcagtg

SEQ ID NO: 71253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggaaacaaatggaaataga

SEQ ID NO: 71254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaggaaacaaatggaaata

SEQ ID NO: 71255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacagttctgaggaaacaaa

SEQ ID NO: 71256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaacagttctgaggaaacaa

SEQ ID NO: 71257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcaaatatcttaaacagtt

SEQ ID NO: 71258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcaaatatcttaaacagt

SEQ ID NO: 71259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacaaacggtttagtcaaa

SEQ ID NO: 71260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagaaaataaccaaagaga

SEQ ID NO: 71261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcagaaaataaccaaagag

SEQ ID NO: 71262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttatcagaaaataaccaaag

SEQ ID NO: 71263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagtaaaacctcttatcaga

SEQ ID NO: 71264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagtaaaacctcttatcag

SEQ ID NO: 71265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacagtaaaacctcttatca

SEQ ID NO: 71266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagaatcaaatcaaaatatt

SEQ ID NO: 71267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatacactccagaatcaa

SEQ ID NO: 71268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atagacagttaaaaatacac

SEQ ID NO: 71269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacctgatagacagttaaaa

SEQ ID NO: 71270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcaacctgatagacagtta

SEQ ID NO: 71271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcaacctgatagacagtt

SEQ ID NO: 71272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagatttcctcaacctgat

SEQ ID NO: 71273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggttgacagatttcctcaa

SEQ ID NO: 71274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggttgacagatttcctca

SEQ ID NO: 71275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaggttgacagatttcctc

SEQ ID NO: 71276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtataagttttcaggttgac

SEQ ID NO: 71277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctagtataagttttcaggtt

SEQ ID NO: 71278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcctagtataagttttcagg

SEQ ID NO: 71279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgctctcctagtataagt

SEQ ID NO: 71280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtgctctcctagtataag

SEQ ID NO: 71281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtgctctcctagtataa

SEQ ID NO: 71282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggagaattttcagtgctct

SEQ ID NO: 71283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggagaattttcagtgctc

SEQ ID NO: 71284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacagagtttatggagaatt

SEQ ID NO: 71285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaacagagtttatggagaa

SEQ ID NO: 71286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaacagagtttatggaga

SEQ ID NO: 71287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtttctcaacagagtttatg

SEQ ID NO: 71288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcatcctggtttctcaacag

SEQ ID NO: 71289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgacctagcatcctggtttc

SEQ ID NO: 71290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgacctagcatcctggttt

SEQ ID NO: 71291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgacctagcatcctggtt

SEQ ID NO: 71292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatgacctagcatcctggt

SEQ ID NO: 71293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttatgacctagcatcctg

SEQ ID NO: 71294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttttatgacctagcatcc

SEQ ID NO: 71295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccaaaaaccctctctttta

SEQ ID NO: 71296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctacccaaaaaccctctct

SEQ ID NO: 71297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccctacccaaaaaccctct

SEQ ID NO: 71298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctccctacccaaaaaccctc

SEQ ID NO: 71299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctccctacccaaaaaccc

SEQ ID NO: 71300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttctccctacccaaaaac

SEQ ID NO: 71301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctctcttctccctacccaa

SEQ ID NO: 71302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccctctcttctccctaccc

SEQ ID NO: 71303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatctctccctctcttctc

SEQ ID NO: 71304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatatctctccctctcttct

SEQ ID NO: 71305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatatctctccctctcttc

SEQ ID NO: 71306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctttgatatctctccctc

SEQ ID NO: 71307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcaaggggaaaaaacatca

SEQ ID NO: 71308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagcaaggggaaaaaacatc

SEQ ID NO: 71309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagcaaggggaaaaaacat

SEQ ID NO: 71310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattttgagcaaggggaaaa

SEQ ID NO: 71311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaacctgcattttgagcaa

SEQ ID NO: 71312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaacctgcattttgagca

SEQ ID NO: 71313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaagaacctgcattttga

SEQ ID NO: 71314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttaagaacctgcattttg

SEQ ID NO: 71315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgtttaagaacctgcatt

SEQ ID NO: 71316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttgtttaagaacctgcat

SEQ ID NO: 71317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcttgtttaagaacctgca

SEQ ID NO: 71318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgcttgtttaagaacctgc

SEQ ID NO: 71319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccttttgcttgtttaagaa

SEQ ID NO: 71320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccttttgcttgtttaaga

SEQ ID NO: 71321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgggtatatttccccttttg

SEQ ID NO: 71322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggggctatgggtatatttc

SEQ ID NO: 71323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaggggctatgggtatat

SEQ ID NO: 71324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcaggggctatgggtata

SEQ ID NO: 71325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattcaggggctatgggtat

SEQ ID NO: 71326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttattcaggggctatgggt

SEQ ID NO: 71327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttattcaggggctatggg

SEQ ID NO: 71328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttattcaggggctatgg

SEQ ID NO: 71329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttctttattcaggggcta

SEQ ID NO: 71330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatattattttctttattc

SEQ ID NO: 71331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagatattattttctttat

SEQ ID NO: 71332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgagatattattttcttta

SEQ ID NO: 71333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggtttctgagatattattt

SEQ ID NO: 71334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattcaggtttctgagatat

SEQ ID NO: 71335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggattcaggtttctgagata

SEQ ID NO: 71336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttggattcaggtttctgag

SEQ ID NO: 71337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acttggattcaggtttctga

SEQ ID NO: 71338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcttacttggattcaggttt

SEQ ID NO: 71339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atccctagcttacttggatt

SEQ ID NO: 71340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatccctagcttacttggat

SEQ ID NO: 71341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataaatgatgccaactta

SEQ ID NO: 71342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaataaatgatgccaactt

SEQ ID NO: 71343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaataaatgatgccaact

SEQ ID NO: 71344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaataaatgatgccaac

SEQ ID NO: 71345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgtcaataatttttaaaa

SEQ ID NO: 71346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatgtgtcaataattttta

SEQ ID NO: 71347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcacatgtaccccataaata

SEQ ID NO: 71348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataatgtatacatgtatca

SEQ ID NO: 71349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataattatataatgtataca

SEQ ID NO: 71350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gataattatataatgtatac

SEQ ID NO: 71351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgataattatataatgta

SEQ ID NO: 71352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctatttgataattatata

SEQ ID NO: 71353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttaccctatttgataatta

SEQ ID NO: 71354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctagttaccctatttgataa

SEQ ID NO: 71355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggatctgctagttacccta

SEQ ID NO: 71356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagctatggatctgctagt

SEQ ID NO: 71357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaaagaaatggtaaatgtt

SEQ ID NO: 71358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcacaaagaaatggtaaat

SEQ ID NO: 71359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatggtctcctcacaaagaa

SEQ ID NO: 71360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatggtctcctcacaaaga

SEQ ID NO: 71361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatggtctcctcacaaag

SEQ ID NO: 71362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatggtctcctcacaaa

SEQ ID NO: 71363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaagtttttaaatggtctcc

SEQ ID NO: 71364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatagctagaagttttta

SEQ ID NO: 71365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaatagctagaagttttt

SEQ ID NO: 71366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatatttcaaaatagctaga

SEQ ID NO: 71367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accataatgtgttgtatatt

SEQ ID NO: 71368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagttaaccataatgtgttg

SEQ ID NO: 71369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgactagagttaaccata

SEQ ID NO: 71370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatcgttggatgactagagt

SEQ ID NO: 71371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgaatcgttggatgactag

SEQ ID NO: 71372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattgaatcgttggatgact

SEQ ID NO: 71373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgttctattgaatcgttgg

SEQ ID NO: 71374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggtgttctattgaatcgtt

SEQ ID NO: 71375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagtgagatagaaagaataa

SEQ ID NO: 71376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcaacaggtacaaagctac

SEQ ID NO: 71377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaggagcgaggtgtggggaa

SEQ ID NO: 71378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaggagcgaggtgtgggga

SEQ ID NO: 71379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcggaggatgggaggcttgg

SEQ ID NO: 71380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatagaagtagatagtaga

SEQ ID NO: 71381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagggttgtcatagaagtag

SEQ ID NO: 71382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acacatatgtggaatctaaa

SEQ ID NO: 71383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgaaatcagccaggcaca

SEQ ID NO: 71384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttaagtgaaatcagccag

SEQ ID NO: 71385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaggacattatgttaagtga

SEQ ID NO: 71386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggcaacatgaatgaacctg

SEQ ID NO: 71387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggcaacatgaatgaacct

SEQ ID NO: 71388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtggcaacatgaatgaa

SEQ ID NO: 71389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatttgtggcaacatgaat

SEQ ID NO: 71390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agccataagaaataatgaaa

SEQ ID NO: 71391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacgccattcagccataaga

SEQ ID NO: 71392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgatcgtaaataaataaa

SEQ ID NO: 71393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acctaaatgatcgtaaataa

SEQ ID NO: 71394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatattaacctaaatgatc

SEQ ID NO: 71395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaatagccaagttatcata

SEQ ID NO: 71396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcacaatagccaagttatc

SEQ ID NO: 71397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactgttcacaatagccaag

SEQ ID NO: 71398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgcactgttcacaatagcc

SEQ ID NO: 71399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgctgcactgttcacaata

SEQ ID NO: 71400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgctgcactgttcacaat

SEQ ID NO: 71401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgtttattgctgcactgt

SEQ ID NO: 71402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctatatgtttattgctgcac

SEQ ID NO: 71403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tactcctatatgtttattgc

SEQ ID NO: 71404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagagatacagtaaacatag

SEQ ID NO: 71405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtaaatatccagatgaaat

SEQ ID NO: 71406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatgatccagcagtcccaa

SEQ ID NO: 71407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatgatccagcagtccca

SEQ ID NO: 71408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatatgatccagcagtccc

SEQ ID NO: 71409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatagaattttcatatga

SEQ ID NO: 71410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaattaaaaatagaattt

SEQ ID NO: 71411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaattaaaaatagaatt

SEQ ID NO: 71412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaaaattaaaaatagaat

SEQ ID NO: 71413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaaaaaattaaaaataga

SEQ ID NO: 71414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggaaagtaatatgggggtt

SEQ ID NO: 71415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaccaccattatggaaagt

SEQ ID NO: 71416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagaatgtaaattagtacc

SEQ ID NO: 71417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attgtgagaatgtaaattag

SEQ ID NO: 71418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacactgattgtgagaatgt

SEQ ID NO: 71419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acacactgattgtgagaatg

SEQ ID NO: 71420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggatatggagaaaaggga

SEQ ID NO: 71421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaggatatggagaaaaggg

SEQ ID NO: 71422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccatcaaaaaatcaaaagat

SEQ ID NO: 71423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatggctaccatcaaaaaa

SEQ ID NO: 71424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttaaaatggctaccatcaa

SEQ ID NO: 71425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accctagttaaaatggctac

SEQ ID NO: 71426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcaccctagttaaaatggc

SEQ ID NO: 71427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggtatctcctcaccctagt

SEQ ID NO: 71428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggtatctcctcaccctag

SEQ ID NO: 71429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcttgaggtatctcctcacc

SEQ ID NO: 71430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcaccagggaaatgcaaat

SEQ ID NO: 71431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacatcactaatcaccaggg

SEQ ID NO: 71432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaagaagacaaagaaatgc

SEQ ID NO: 71433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaaagaagacaaagaaat

SEQ ID NO: 71434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaaaagaagacaaagaaa

SEQ ID NO: 71435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatagatatttctcaaaaga

SEQ ID NO: 71436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaatggacaaaagacctg

SEQ ID NO: 71437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacaacgacaaaaaaaacaa

SEQ ID NO: 71438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaacaactcaacaacgacaa

SEQ ID NO: 71439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaacatacaaggaactcaaa

SEQ ID NO: 71440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatctaaaacatacaagga

SEQ ID NO: 71441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataatgggttaatatctaaa

SEQ ID NO: 71442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcatctgataatgggttaa

SEQ ID NO: 71443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaactatgcatctgataat

SEQ ID NO: 71444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaactatgcatctgataa

SEQ ID NO: 71445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagaatgggaaaataaattt

SEQ ID NO: 71446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacagcaaggcaaacaatca

SEQ ID NO: 71447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcacagcaaggcaaacaat

SEQ ID NO: 71448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgcacagcaaggcaaacaa

SEQ ID NO: 71449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaagcttctgcacagcaag

SEQ ID NO: 71450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactaaaaagcttctgcaca

SEQ ID NO: 71451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattaaactaaaaagcttct

SEQ ID NO: 71452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattatattaaactaaaaag

SEQ ID NO: 71453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaagcacaggcaacaaaag

SEQ ID NO: 71454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gataaaacctaaaaagcaca

SEQ ID NO: 71455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggataaaacctaaaaagcac

SEQ ID NO: 71456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggataaaacctaaaaagca

SEQ ID NO: 71457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggataaaacctaaaaagc

SEQ ID NO: 71458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttggataaaacctaaaaag

SEQ ID NO: 71459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttggataaaacctaaaaa

SEQ ID NO: 71460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcaaggatttttttggata

SEQ ID NO: 71461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggcaaggatttttttgga

SEQ ID NO: 71462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctaggcaaggattttttt

SEQ ID NO: 71463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgatgttgttctaggcaag

SEQ ID NO: 71464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgatgttgttctaggcaa

SEQ ID NO: 71465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagaagaaaaaaaacagggg

SEQ ID NO: 71466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttagagaagaaaaaaaacag

SEQ ID NO: 71467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacaactattagagaagaaa

SEQ ID NO: 71468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaactacacaactattaga

SEQ ID NO: 71469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgtaagactgaaaactac

SEQ ID NO: 71470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatgtaagactgaaaacta

SEQ ID NO: 71471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttaaatgtaagactgaaaa

SEQ ID NO: 71472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaatagactacttaaatgt

SEQ ID NO: 71473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacacaagtcaactcaaaat

SEQ ID NO: 71474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacacaagtcaactcaaaa

SEQ ID NO: 71475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatacacaagtcaactcaaa

SEQ ID NO: 71476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttatacacaagtcaactc

SEQ ID NO: 71477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actttatacacaagtcaact

SEQ ID NO: 71478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttactttatacacaagtcaa

SEQ ID NO: 71479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctcttactttatacacaag

SEQ ID NO: 71480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctcttactttatacacaa

SEQ ID NO: 71481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatctcttactttatacaca

SEQ ID NO: 71482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacctttatctcttacttta

SEQ ID NO: 71483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatagccacatgcaaaagaa

SEQ ID NO: 71484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcaaactgaatagccacat

SEQ ID NO: 71485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggcaaactgaatagccac

SEQ ID NO: 71486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaatggttctgggcaaac

SEQ ID NO: 71487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtaaatggttctgggcaaa

SEQ ID NO: 71488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtaaatggttctgggcaa

SEQ ID NO: 71489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttagtaaatggttctgggc

SEQ ID NO: 71490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taatagagaaaggacagcct

SEQ ID NO: 71491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagtacctataatagagaa

SEQ ID NO: 71492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaaggttccaagtacctat

SEQ ID NO: 71493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacaaggttccaagtaccta

SEQ ID NO: 71494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacaaggttccaagtacct

SEQ ID NO: 71495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttttgacaaggttccaag

SEQ ID NO: 71496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacatatacagtcaactgag

SEQ ID NO: 71497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acataaaacagacacacaga

SEQ ID NO: 71498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagtaaccaaacagaatgat

SEQ ID NO: 71499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaagctatagtaaccaaac

SEQ ID NO: 71500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaacatactataaagctat

SEQ ID NO: 71501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaaacatactataaagcta

SEQ ID NO: 71502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acttcaaaacatactataaa

SEQ ID NO: 71503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actgacttcaaaacatacta

SEQ ID NO: 71504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acactaactgacttcaaaac

SEQ ID NO: 71505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacactaactgacttcaaaa

SEQ ID NO: 71506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggcttcacactaactgac

SEQ ID NO: 71507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaacaaaaagaacaaagctg

SEQ ID NO: 71508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatagcccaagtaacctgga

SEQ ID NO: 71509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatgaaaccacaaaagaccc

SEQ ID NO: 71510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatgaaaccacaaaagacc

SEQ ID NO: 71511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acatttgtatgaaaccacaa

SEQ ID NO: 71512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagaaaaaaaaaaaaaaagt

SEQ ID NO: 71513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagaaaaaaaaaaaaaaag

SEQ ID NO: 71514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacagaaaaaaaaaaaaaaa

SEQ ID NO: 71515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttacagaaaaaaaaaaaaa

SEQ ID NO: 71516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaaaataccagtgacattc

SEQ ID NO: 71517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgcaatccctatcaaaata

SEQ ID NO: 71518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgcaatccctatcaaaat

SEQ ID NO: 71519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caggtttaatgcaatcccta

SEQ ID NO: 71520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccaaagcaatctacaggtt

SEQ ID NO: 71521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgtccatattacccaaa

SEQ ID NO: 71522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatgtccatattacccaa

SEQ ID NO: 71523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatgtccatattaccca

SEQ ID NO: 71524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaatgtccatattaccc

SEQ ID NO: 71525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttaaaatgtccatatta

SEQ ID NO: 71526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatttttaaaatgtccata

SEQ ID NO: 71527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaataattattatttttaaa

SEQ ID NO: 71528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atggattagaataattatta

SEQ ID NO: 71529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgttcatggattagaata

SEQ ID NO: 71530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaggacacaaaaagggaa

SEQ ID NO: 71531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgagagaaattgaagagga

SEQ ID NO: 71532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaatattggtgagagaaa

SEQ ID NO: 71533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatgaaaactataaaatat

SEQ ID NO: 71534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaatgaaaactataaaata

SEQ ID NO: 71535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacaaggaggtgaaatatat

SEQ ID NO: 71536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacaaggaggtgaaatata

SEQ ID NO: 71537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaataaatttaaacaagga

SEQ ID NO: 71538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaaaataaaatacctaga

SEQ ID NO: 71539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatagctacaaaaaataaa

SEQ ID NO: 71540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaatagctacaaaaaataa

SEQ ID NO: 71541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaataagaaagcaatccca

SEQ ID NO: 71542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaacaaataatctgaaaat

SEQ ID NO: 71543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgttaacaacaaataatc

SEQ ID NO: 71544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatatgttaacaacaaataa

SEQ ID NO: 71545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatatgttaacaacaaata

SEQ ID NO: 71546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctatatgttaacaacaa

SEQ ID NO: 71547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaggacacaaaatcaacatg

SEQ ID NO: 71548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtaatgttggaggacacaa

SEQ ID NO: 71549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaatgaattcagtaatgt

SEQ ID NO: 71550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cataaatgaattcagtaatg

SEQ ID NO: 71551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgaccccatgaaaaaaagt

SEQ ID NO: 71552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatgaccccatgaaaaaaa

SEQ ID NO: 71553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatatagagagttctaatga

SEQ ID NO: 71554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agatatagagagttctaatg

SEQ ID NO: 71555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcttagatatagagagttc

SEQ ID NO: 71556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgatctgatcttagatat

SEQ ID NO: 71557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgatctgatcttagata

SEQ ID NO: 71558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatgatctgatcttagat

SEQ ID NO: 71559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatatgatctgatcttaga

SEQ ID NO: 71560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttatatgatctgatctt

SEQ ID NO: 71561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttatatgatctgatct

SEQ ID NO: 71562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtttttatatgatctgatc

SEQ ID NO: 71563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgtttttatatgatctga

SEQ ID NO: 71564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttgtttttatatgatct

SEQ ID NO: 71565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaagaaggaagtcaaattc

SEQ ID NO: 71566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattggaaagaaggaagtca

SEQ ID NO: 71567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattggaaagaaggaagtc

SEQ ID NO: 71568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gccagagcaatcaggcaaga

SEQ ID NO: 71569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagccagagcaatcaggcaa

SEQ ID NO: 71570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacatagtaatgaagttcta

SEQ ID NO: 71571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaacatagtaatgaagtt

SEQ ID NO: 71572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcaacatagtaatgaagt

SEQ ID NO: 71573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattcaacatagtaatgaag

SEQ ID NO: 71574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattcaacatagtaatgaa

SEQ ID NO: 71575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttttattcaacatagtaat

SEQ ID NO: 71576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actacttttattcaacatag

SEQ ID NO: 71577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactacttttattcaacata

SEQ ID NO: 71578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcactacttttattcaacat

SEQ ID NO: 71579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaacaagataaggatgccca

SEQ ID NO: 71580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caagatctggaacaagataa

SEQ ID NO: 71581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccaagatctggaacaagat

SEQ ID NO: 71582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctccaagatctggaacaag

SEQ ID NO: 71583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctccaagatctggaacaa

SEQ ID NO: 71584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctctccaagatctggaaca

SEQ ID NO: 71585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagctttctctccaagatc

SEQ ID NO: 71586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
accagggaagagctgaaagc

SEQ ID NO: 71587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acatgatactaaccagggaa

SEQ ID NO: 71588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtaatgaaggccatatgt

SEQ ID NO: 71589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatgtaatgaaggccatatg

SEQ ID NO: 71590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtatagaagaaacatacct

SEQ ID NO: 71591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaacaaattaagtatagaa

SEQ ID NO: 71592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataaaaattatcaacaaatt

SEQ ID NO: 71593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gataaaaattatcaacaaat

SEQ ID NO: 71594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgataaaaattatcaaca

SEQ ID NO: 71595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgataaaaattatcaac

SEQ ID NO: 71596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttgataaaaattatcaa

SEQ ID NO: 71597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaatccagtatcctttat

SEQ ID NO: 71598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaaatccagtatccttta

SEQ ID NO: 71599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataaaatccagtatccttt

SEQ ID NO: 71600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatagacagagaaaaagcat

SEQ ID NO: 71601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcaacagaatgaaacata

SEQ ID NO: 71602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattatatcaacagaatgaa

SEQ ID NO: 71603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatattatatcaacagaatg

SEQ ID NO: 71604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatattatatcaacagaat

SEQ ID NO: 71605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctatattatatcaacagaa

SEQ ID NO: 71606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagaacaataaactttctat

SEQ ID NO: 71607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagaacaataaactttcta

SEQ ID NO: 71608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacatttgcagaacaataaa

SEQ ID NO: 71609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacatttgcagaacaataa

SEQ ID NO: 71610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaatcgtcccagggatgca

SEQ ID NO: 71611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aactggaaatcgtcccaggg

SEQ ID NO: 71612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accatgctcaactggaaatc

SEQ ID NO: 71613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaccatgctcaactggaa

SEQ ID NO: 71614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaaaaagattattcaccat

SEQ ID NO: 71615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatccaacagcctatcaaa

SEQ ID NO: 71616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcaactcaaatccaacagcc

SEQ ID NO: 71617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgaacacagatgcaaaatg

SEQ ID NO: 71618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tccctgatgaacacagatgc

SEQ ID NO: 71619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaggccactatccctgatga

SEQ ID NO: 71620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccccaataccagaacaagac

SEQ ID NO: 71621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaggccaatattaccccaa

SEQ ID NO: 71622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaaggccaatattacccc

SEQ ID NO: 71623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attctacaaggccaatatta

SEQ ID NO: 71624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattcattctacaaggccaa

SEQ ID NO: 71625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaattcattctacaaggcc

SEQ ID NO: 71626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaaattcattctacaaggc

SEQ ID NO: 71627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctaaattcattctacaag

SEQ ID NO: 71628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaaaaatcaaaaggaaag

SEQ ID NO: 71629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttccaaaaaaatcaaaagga

SEQ ID NO: 71630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattattccaaaaaaatcaa

SEQ ID NO: 71631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaattattccaaaaaaatca

SEQ ID NO: 71632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaattattccaaaaaaat

SEQ ID NO: 71633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttaaattattccaaaaaaa

SEQ ID NO: 71634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttaaattattccaaaaa

SEQ ID NO: 71635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attcttcttaaattattcca

SEQ ID NO: 71636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atactaattcttcttaaatt

SEQ ID NO: 71637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaagaactaatactaatt

SEQ ID NO: 71638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagaagaactaatactaat

SEQ ID NO: 71639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaaacatttaaagaagaac

SEQ ID NO: 71640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taccaaacatttaaagaaga

SEQ ID NO: 71641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgaattctaccaaacattt

SEQ ID NO: 71642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgatgaattctaccaaac

SEQ ID NO: 71643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cactgatgaattctaccaaa

SEQ ID NO: 71644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcaaagaaaagtccaggacc

SEQ ID NO: 71645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctagcaaagaaaagtccagg

SEQ ID NO: 71646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcctagcaaagaaaagtcca

SEQ ID NO: 71647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatcagtaataaaatctctc

SEQ ID NO: 71648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaacagaccaataatgagta

SEQ ID NO: 71649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatcatgaagaaatggaaaa

SEQ ID NO: 71650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaagactgtatcatgaaga

SEQ ID NO: 71651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccaagactgtatcatgaag

SEQ ID NO: 71652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacacatacaacttgccaag

SEQ ID NO: 71653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcaacacatacaacttgcc

SEQ ID NO: 71654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataaattactcaacacatac

SEQ ID NO: 71655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atggaaattgataaattact

SEQ ID NO: 71656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaacctaatggaaattga

SEQ ID NO: 71657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caacaaattggaaaacctaa

SEQ ID NO: 71658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaacaatcatactccaaca

SEQ ID NO: 71659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctatgaacaatcatactcca

SEQ ID NO: 71660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcaatagagactactatga

SEQ ID NO: 71661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgatcaatagagactacta

SEQ ID NO: 71662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagcagctactgatcaatag

SEQ ID NO: 71663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagcagctactgatcaata

SEQ ID NO: 71664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaacgtttgcagcagctac

SEQ ID NO: 71665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaatcattaacaacgtttg

SEQ ID NO: 71666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagaatcattaacaacgttt

SEQ ID NO: 71667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgcaacttcagaatcatt

SEQ ID NO: 71668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggatgcaacttcagaatcat

SEQ ID NO: 71669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatttggatgcaacttcaga

SEQ ID NO: 71670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctaaatttggatgcaactt

SEQ ID NO: 71671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctaaatttggatgcaact

SEQ ID NO: 71672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgcctaaatttggatgca

SEQ ID NO: 71673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattgtttgcctaaatttgg

SEQ ID NO: 71674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattgtttgcctaaatttg

SEQ ID NO: 71675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaattgtttgcctaaattt

SEQ ID NO: 71676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatcatatcctttgaattgt

SEQ ID NO: 71677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggatcatatcctttgaatt

SEQ ID NO: 71678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctggatcatatcctttga

SEQ ID NO: 71679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaatgcctgttctggatca

SEQ ID NO: 71680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacaaatgcctgttctgga

SEQ ID NO: 71681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attacaaatgcctgttctgg

SEQ ID NO: 71682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattacaaatgcctgttctg

SEQ ID NO: 71683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggactttattacaaatgcc

SEQ ID NO: 71684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggggactttattacaaatgc

SEQ ID NO: 71685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtgtgaaagacatacttg

SEQ ID NO: 71686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgtgtgaaagacatactt

SEQ ID NO: 71687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgtgtgaaagacatact

SEQ ID NO: 71688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaattttagtgtgtgaaag

SEQ ID NO: 71689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagaattttagtgtgtgaaa

SEQ ID NO: 71690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagagatagcgtgatgaag

SEQ ID NO: 71691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagagatagcgtgatgaa

SEQ ID NO: 71692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatttaaaagagatagcgtg

SEQ ID NO: 71693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagattgaatttaaaagaga

SEQ ID NO: 71694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttacagattgaatttaaaa

SEQ ID NO: 71695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttggttacagattgaattta

SEQ ID NO: 71696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taagtagctattggttacag

SEQ ID NO: 71697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatacacactgtaagtagct

SEQ ID NO: 71698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatacacactgtaagtagc

SEQ ID NO: 71699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtgcttatatacacactgt

SEQ ID NO: 71700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagtatggaattgagtgct

SEQ ID NO: 71701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttataagtatggaattgagt

SEQ ID NO: 71702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatgtacaattattataagt

SEQ ID NO: 71703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaagtgctcaatgtacaat

SEQ ID NO: 71704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaaaagtgctcaatgtac

SEQ ID NO: 71705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgaaaagtgctcaatgta

SEQ ID NO: 71706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacaaatgcttattgaaaag

SEQ ID NO: 71707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataaataattagacaaatgc

SEQ ID NO: 71708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcataaataattagacaaat

SEQ ID NO: 71709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgattctcataaataatt

SEQ ID NO: 71710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taataaagattatatgattc

SEQ ID NO: 71711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgtaaaatagattgtaat

SEQ ID NO: 71712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtgtaaaatagattgtaa

SEQ ID NO: 71713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatgtgtaaaatagattg

SEQ ID NO: 71714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatgtgtaaaatagatt

SEQ ID NO: 71715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtttatttatgtgtaaaat

SEQ ID NO: 71716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtttatttatgtgtaaaa

SEQ ID NO: 71717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtttatttatgtgtaaa

SEQ ID NO: 71718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcagtttatttatgtgtaa

SEQ ID NO: 71719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcagtttatttatgtgta

SEQ ID NO: 71720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcagtttatttatgtgt

SEQ ID NO: 71721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaaacatttttttcagtt

SEQ ID NO: 71722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaaaacatttttttcagt

SEQ ID NO: 71723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcaatttacaaaaacattt

SEQ ID NO: 71724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagcaatttacaaaaacatt

SEQ ID NO: 71725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataagaccttgagcaattta

SEQ ID NO: 71726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gataagaccttgagcaattt

SEQ ID NO: 71727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgataagaccttgagcaatt

SEQ ID NO: 71728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgataagaccttgagcaat

SEQ ID NO: 71729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcttttgataagaccttgag

SEQ ID NO: 71730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcttttgataagaccttga

SEQ ID NO: 71731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatcttagcttttgataag

SEQ ID NO: 71732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctcaaatcttagcttttga

SEQ ID NO: 71733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctcaaatcttagcttttg

SEQ ID NO: 71734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agatagaatatttgcctcaa

SEQ ID NO: 71735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagatagaatatttgcctca

SEQ ID NO: 71736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagatagaatatttgcctc

SEQ ID NO: 71737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagatagaatatttgcct

SEQ ID NO: 71738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaagatagaatatttgcc

SEQ ID NO: 71739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaatgccactttttaagat

SEQ ID NO: 71740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggatatagttaagaatgcca

SEQ ID NO: 71741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggatatagttaagaatgcc

SEQ ID NO: 71742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccttgggatatagttaagaa

SEQ ID NO: 71743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccactaccttgggatatag

SEQ ID NO: 71744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agccactaccttgggatata

SEQ ID NO: 71745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtcttagccactaccttgg

SEQ ID NO: 71746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtcattaagtcttagccac

SEQ ID NO: 71747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtcattaagtcttagcca

SEQ ID NO: 71748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatttatgtcattaagtc

SEQ ID NO: 71749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatatttatgtcattaagt

SEQ ID NO: 71750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttatatatttatgtcatt

SEQ ID NO: 71751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaatttatatatttatgtc

SEQ ID NO: 71752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccaatagaaagtaactcct

SEQ ID NO: 71753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattacccaatagaaagtaa

SEQ ID NO: 71754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatgagccaaagaggcaaat

SEQ ID NO: 71755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatgagcctggatgagcca

SEQ ID NO: 71756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgatgagcctggatgagcc

SEQ ID NO: 71757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttgtgatgagcctggat

SEQ ID NO: 71758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatagtgatggttgtgttt

SEQ ID NO: 71759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaatagtgatggttgtgtt

SEQ ID NO: 71760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaaatagtgatggttgtgt

SEQ ID NO: 71761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatgcctttgaaatagtga

SEQ ID NO: 71762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtatctgagatgcctttgaa

SEQ ID NO: 71763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgtatctgagatgcctttga

SEQ ID NO: 71764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgtatctgagatgcctttg

SEQ ID NO: 71765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcgtatctgagatgccttt

SEQ ID NO: 71766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcgtatctgagatgcctt

SEQ ID NO: 71767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcgtatctgagatgcct

SEQ ID NO: 71768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttttcgtatctgagatg

SEQ ID NO: 71769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttttcgtatctgagat

SEQ ID NO: 71770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttttttcgtatctgaga

SEQ ID NO: 71771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatttttttcgtatctgag

SEQ ID NO: 71772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caacttttatttttttcgta

SEQ ID NO: 71773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaacttttatttttttcgt

SEQ ID NO: 71774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcaacttttatttttttcg

SEQ ID NO: 71775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgcaacttttatttttttc

SEQ ID NO: 71776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttgcaacttttatttttt

SEQ ID NO: 71777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctcttttgcaacttttatt

SEQ ID NO: 71778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaattccctcttttgcaac

SEQ ID NO: 71779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactgtgaattccctctttt

SEQ ID NO: 71780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaactgtgaattccctcttt

SEQ ID NO: 71781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagagtcttgaactgtgaa

SEQ ID NO: 71782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttcccagagtcttgaact

SEQ ID NO: 71783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagttcccagagtcttgaac

SEQ ID NO: 71784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccacttgagttcccagagtc

SEQ ID NO: 71785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctcccacttgagttccca

SEQ ID NO: 71786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catctcccacttgagttccc

SEQ ID NO: 71787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataatcttcatctcccactt

SEQ ID NO: 71788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcataatcttcatctcccac

SEQ ID NO: 71789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attctcataatcttcatctc

SEQ ID NO: 71790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taattctcataatcttcatc

SEQ ID NO: 71791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctctaattctcataatcttc

SEQ ID NO: 71792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgctctaattctcataatc

SEQ ID NO: 71793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgctctaattctcataat

SEQ ID NO: 71794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgctctaattctcataa

SEQ ID NO: 71795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcctgctctaattctcata

SEQ ID NO: 71796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acttttcctgctctaattct

SEQ ID NO: 71797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgctaacttttcctgctcta

SEQ ID NO: 71798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctatgctaacttttcctgct

SEQ ID NO: 71799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcctcctatgctaactttt

SEQ ID NO: 71800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcctcctatgctaacttt

SEQ ID NO: 71801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatcctcctatgctaactt

SEQ ID NO: 71802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatgtctttaatcctccta

SEQ ID NO: 71803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctaaaatgtctttaatcct

SEQ ID NO: 71804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctaaaatgtctttaatcc

SEQ ID NO: 71805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtctaaaatgtctttaa

SEQ ID NO: 71806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgtctaaaatgtcttta

SEQ ID NO: 71807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatttgtctaaaatgtct

SEQ ID NO: 71808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatttgtctaaaatgtc

SEQ ID NO: 71809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttatttgtctaaaatgt

SEQ ID NO: 71810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatagtgtacattttattt

SEQ ID NO: 71811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatcactaaaatagtgtac

SEQ ID NO: 71812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccattcagatcactaaaata

SEQ ID NO: 71813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccattcagatcactaaaat

SEQ ID NO: 71814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccattcagatcactaaaa

SEQ ID NO: 71815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttcccattcagatcacta

SEQ ID NO: 71816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttcccattcagatcact

SEQ ID NO: 71817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttcccattcagatcac

SEQ ID NO: 71818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttgttttcccattcagat

SEQ ID NO: 71819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttgttttcccattcaga

SEQ ID NO: 71820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttgttttcccattcag

SEQ ID NO: 71821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttgttttgttttcccatt

SEQ ID NO: 71822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttgttttgttttcccat

SEQ ID NO: 71823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttgttttgttttccca

SEQ ID NO: 71824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttttgttttgttttccc

SEQ ID NO: 71825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcatttttgttttgttttgt

SEQ ID NO: 71826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtcatttttgttttgtttt

SEQ ID NO: 71827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattctgtcatttttgtttt

SEQ ID NO: 71828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattctgtcatttttgttt

SEQ ID NO: 71829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagtttaaattctgtcattt

SEQ ID NO: 71830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagtttaaattctgtcatt

SEQ ID NO: 71831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgtttccagtttaaatt

SEQ ID NO: 71832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agattaaaatgtttccagtt

SEQ ID NO: 71833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagattaaaatgtttccagt

SEQ ID NO: 71834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcagattaaaatgtttcca

SEQ ID NO: 71835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagcctcttcagattaaaat

SEQ ID NO: 71836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagcctcttcagattaaaa

SEQ ID NO: 71837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccagcctcttcagattaaa

SEQ ID NO: 71838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttccagcctcttcagatta

SEQ ID NO: 71839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttccagcctcttcagatt

SEQ ID NO: 71840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctttccagcctcttcagat

SEQ ID NO: 71841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggtctttctttccagcctc

SEQ ID NO: 71842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catctaaggtctttctttcc

SEQ ID NO: 71843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatctaaggtctttctttc

SEQ ID NO: 71844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaaaccttacatctaagg

SEQ ID NO: 71845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggtcaactataaaaacctt

SEQ ID NO: 71846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agctgtggtcaactataaaa

SEQ ID NO: 71847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataagatattaagctgtggt

SEQ ID NO: 71848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gataagatattaagctgtgg

SEQ ID NO: 71849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgataagatattaagctg

SEQ ID NO: 71850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgataagatattaagct

SEQ ID NO: 71851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaggaaatttgtttgataag

SEQ ID NO: 71852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagatctagaggaaatttgt

SEQ ID NO: 71853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaataatgaaggttcaag

SEQ ID NO: 71854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaatataagaattgagaaa

SEQ ID NO: 71855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctgaaaatataagaattga

SEQ ID NO: 71856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtatagacaaacctacctg

SEQ ID NO: 71857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagtatgtcatattaagta

SEQ ID NO: 71858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgacgtatctcaaagtat

SEQ ID NO: 71859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatgacgtatctcaaagta

SEQ ID NO: 71860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatgacgtatctcaaagt

SEQ ID NO: 71861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaaaaattttccatgacg

SEQ ID NO: 71862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cataaaaaattttccatgac

SEQ ID NO: 71863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcataaaaaattttccatg

SEQ ID NO: 71864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttcataaaaaattttccat

SEQ ID NO: 71865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccttcttcataaaaaattt

SEQ ID NO: 71866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acccttcttcataaaaaatt

SEQ ID NO: 71867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagtttacccttcttcata

SEQ ID NO: 71868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagtttacccttcttcat

SEQ ID NO: 71869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaaagtttacccttcttca

SEQ ID NO: 71870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaactttgaaagtttaccc

SEQ ID NO: 71871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attatgaactttgaaagttt

SEQ ID NO: 71872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taattatgaactttgaaagt

SEQ ID NO: 71873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaattatgaactttgaaag

SEQ ID NO: 71874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acttctaattatgaactttg

SEQ ID NO: 71875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgacttctaattatgaact

SEQ ID NO: 71876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgctactgacttctaatta

SEQ ID NO: 71877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtgctactgacttctaatt

SEQ ID NO: 71878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagtgctactgacttctaa

SEQ ID NO: 71879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggttcttagtgctactgac

SEQ ID NO: 71880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaactcaggttcttagtgc

SEQ ID NO: 71881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagaactcaggttcttagtg

SEQ ID NO: 71882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttaagaactcaggttctta

SEQ ID NO: 71883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacttaagaactcaggttc

SEQ ID NO: 71884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattacttaagaactcagg

SEQ ID NO: 71885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catcattattattacttaag

SEQ ID NO: 71886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcatcattattattactta

SEQ ID NO: 71887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcatcattattattactt

SEQ ID NO: 71888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatcgatttctgcatcatt

SEQ ID NO: 71889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtcatcgatttctgcatc

SEQ ID NO: 71890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgtcatcgatttctgcat

SEQ ID NO: 71891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaagtgtttgttgtcat

SEQ ID NO: 71892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaaagtgtttgttgtca

SEQ ID NO: 71893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaaagtgtttgttgtc

SEQ ID NO: 71894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaagccattttaaaaaaag

SEQ ID NO: 71895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattagcaagccattttaaa

SEQ ID NO: 71896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattagcaagccattttaa

SEQ ID NO: 71897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtcatgtagcatagtgttt

SEQ ID NO: 71898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtcatgtagcatagtgtt

SEQ ID NO: 71899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtcatgtagcatagtgt

SEQ ID NO: 71900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagtcatgtagcatagtg

SEQ ID NO: 71901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtatttttaagtcatgtagc

SEQ ID NO: 71902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtaacagatacacaagct

SEQ ID NO: 71903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaggttgtagtaacagatac

SEQ ID NO: 71904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaggttgtagtaacagata

SEQ ID NO: 71905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccttagaggttgtagtaaca

SEQ ID NO: 71906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggctaccttagaggttgta

SEQ ID NO: 71907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggctaccttagaggttgt

SEQ ID NO: 71908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatacaggagtttgtggc

SEQ ID NO: 71909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catggtatgcacaattaaat

SEQ ID NO: 71910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatggtatgcacaattaaa

SEQ ID NO: 71911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttccatggtatgcacaa

SEQ ID NO: 71912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttacatttccatggtatgca

SEQ ID NO: 71913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattacatttccatggtatg

SEQ ID NO: 71914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctattacatttccatggt

SEQ ID NO: 71915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actctattacatttccatgg

SEQ ID NO: 71916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttactctattacatttccat

SEQ ID NO: 71917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgataaaagagtgtacat

SEQ ID NO: 71918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatctatatgataaaagagt

SEQ ID NO: 71919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataatggttatatctatat

SEQ ID NO: 71920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attacataatggttatatct

SEQ ID NO: 71921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcattacataatggttatat

SEQ ID NO: 71922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcattacataatggttata

SEQ ID NO: 71923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcattacataatggttat

SEQ ID NO: 71924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcattacataatggtta

SEQ ID NO: 71925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctcattacataatggtt

SEQ ID NO: 71926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctcattacataatggt

SEQ ID NO: 71927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttttttctcattacataa

SEQ ID NO: 71928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actaatttttttctcattac

SEQ ID NO: 71929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactaatttttttctcatta

SEQ ID NO: 71930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcactaatttttttctcatt

SEQ ID NO: 71931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttcactaatttttttct

SEQ ID NO: 71932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gattttcactaatttttttc

SEQ ID NO: 71933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgattttcactaatttttt

SEQ ID NO: 71934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atattcttgattttcactaa

SEQ ID NO: 71935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatattcttgattttcact

SEQ ID NO: 71936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atattctaatattcttgatt

SEQ ID NO: 71937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgttaatattctaatattc

SEQ ID NO: 71938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgttaatattctaatatt

SEQ ID NO: 71939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatcatttgatgttaata

SEQ ID NO: 71940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctaaaaatcatttgatgtt

SEQ ID NO: 71941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttgtctaaaaatcatttg

SEQ ID NO: 71942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaactgagttgtctaaaaa

SEQ ID NO: 71943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgccctataaactgagttg

SEQ ID NO: 71944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgaaagcgtatgaaatctag

SEQ ID NO: 71945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccgaaagcgtatgaaatcta

SEQ ID NO: 71946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgagcccttccgaaagcg

SEQ ID NO: 71947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttccatgagcccttccgaaa

SEQ ID NO: 71948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attccatgagcccttccgaa

SEQ ID NO: 71949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcacttattccatgagccct

SEQ ID NO: 71950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtcacttattccatgagcc

SEQ ID NO: 71951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctgtcacttattccatga

SEQ ID NO: 71952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaaattactctgtcactt

SEQ ID NO: 71953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accattcataaaattactct

SEQ ID NO: 71954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaccattcataaaattactc

SEQ ID NO: 71955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaccattcataaaattact

SEQ ID NO: 71956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaaccattcataaaatt

SEQ ID NO: 71957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatagattattttaaccat

SEQ ID NO: 71958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taactgaaatagattatttt

SEQ ID NO: 71959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataactgaaatagattattt

SEQ ID NO: 71960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataactgaaatagattatt

SEQ ID NO: 71961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattttataactgaaataga

SEQ ID NO: 71962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattttataactgaaatag

SEQ ID NO: 71963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtattttataactgaaa

SEQ ID NO: 71964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgtattttataactgaa

SEQ ID NO: 71965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttgtattttataactga

SEQ ID NO: 71966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgattttatttgtatttta

SEQ ID NO: 71967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taactagtgattttatttgt

SEQ ID NO: 71968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataactagtgattttatttg

SEQ ID NO: 71969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataactagtgattttattt

SEQ ID NO: 71970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttataactagtgattttatt

SEQ ID NO: 71971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcttttataactagtgattt

SEQ ID NO: 71972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctatcttttataactagtg

SEQ ID NO: 71973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcataatggttagctatctt

SEQ ID NO: 71974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggcatgcagatgaaggtgt

SEQ ID NO: 71975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatctgtggcatgcagat

SEQ ID NO: 71976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatatctgtggcatgcaga

SEQ ID NO: 71977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagaatttatatatctgtgg

SEQ ID NO: 71978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggtataaagccatgcagct

SEQ ID NO: 71979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccctggggtataaagccatg

SEQ ID NO: 71980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctcccctggggtataaagc

SEQ ID NO: 71981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctcccctggggtataaag

SEQ ID NO: 71982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatttgtctcccctgggg

SEQ ID NO: 71983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aataatttgtctcccctggg

SEQ ID NO: 71984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacttaataatttgtctccc

SEQ ID NO: 71985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttggacttaataatttgtct

SEQ ID NO: 71986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattggacttaataatttg

SEQ ID NO: 71987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaacacaaaacaaacattcc

SEQ ID NO: 71988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaacacaaaacaaacattc

SEQ ID NO: 71989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccatttgaaacacaaaaca

SEQ ID NO: 71990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtccatttgaaacacaaaac

SEQ ID NO: 71991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtccatttgaaacacaaaa

SEQ ID NO: 71992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgtccatttgaaacacaa

SEQ ID NO: 71993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctttgtccatttgaaacac

SEQ ID NO: 71994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcctctctttgtccatttga

SEQ ID NO: 71995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcctctctttgtccatttg

SEQ ID NO: 71996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtcctctctttgtccatt

SEQ ID NO: 71997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttgtcctctctttgtcca

SEQ ID NO: 71998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctctcttgtcctctctttg

SEQ ID NO: 71999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacctctcttgtcctctctt

SEQ ID NO: 72000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacctctcttgtcctctct

SEQ ID NO: 72001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatggaatttctacctctct

SEQ ID NO: 72002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagctcaatggaatttctac

SEQ ID NO: 72003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagctcaatggaatttcta

SEQ ID NO: 72004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgacttatagctcaatggaa

SEQ ID NO: 72005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgacttatagctcaatgga

SEQ ID NO: 72006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcttgtgacttatagctca

SEQ ID NO: 72007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaggcagagccatgtcaa

SEQ ID NO: 72008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacagttataaaggcagagc

SEQ ID NO: 72009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagagttatacagttataaa

SEQ ID NO: 72010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagttatagagttatacagt

SEQ ID NO: 72011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaatctagagttatagagt

SEQ ID NO: 72012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacagttataaatctagagt

SEQ ID NO: 72013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagttatacagttataaatc

SEQ ID NO: 72014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagctagagttatacagt

SEQ ID NO: 72015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagttataaagctagagtt

SEQ ID NO: 72016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcacagttataaagctaga

SEQ ID NO: 72017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcacagttataaagctag

SEQ ID NO: 72018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattcacagttataaagcta

SEQ ID NO: 72019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaggaagtgattttattca

SEQ ID NO: 72020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attaaaaggaagtgatttta

SEQ ID NO: 72021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaaagcagactcattaaaa

SEQ ID NO: 72022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actgaaaaagcagactcatt

SEQ ID NO: 72023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taactgaaaaagcagactca

SEQ ID NO: 72024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaactgaaaaagcagactc

SEQ ID NO: 72025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaactgaaaaagcagact

SEQ ID NO: 72026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttctaactgaaaaagca

SEQ ID NO: 72027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattttctaactgaaaaagc

SEQ ID NO: 72028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcacttcattttctaactga

SEQ ID NO: 72029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcacttcattttctaactg

SEQ ID NO: 72030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttagcacttcattttct

SEQ ID NO: 72031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatttagcacttcattttc

SEQ ID NO: 72032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccatttagcacttcatttt

SEQ ID NO: 72033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagaactttccatttagcac

SEQ ID NO: 72034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagaactttccatttagca

SEQ ID NO: 72035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agggaaccttatagaacttt

SEQ ID NO: 72036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagggaaccttatagaactt

SEQ ID NO: 72037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagggaaccttatagaact

SEQ ID NO: 72038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagggaaccttatagaac

SEQ ID NO: 72039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caacatttttaagggaacct

SEQ ID NO: 72040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttgcaacatttttaaggg

SEQ ID NO: 72041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatgttgagttgcaacatt

SEQ ID NO: 72042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtatgttgagttgcaacat

SEQ ID NO: 72043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagtatgttgagttgcaac

SEQ ID NO: 72044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttagtatgttgagttgc

SEQ ID NO: 72045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcttagtatgttgagttg

SEQ ID NO: 72046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattcttagtatgttgagt

SEQ ID NO: 72047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acaaaattcttattcttagt

SEQ ID NO: 72048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgacaaaattcttattctt

SEQ ID NO: 72049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctgctgacaaaattcttat

SEQ ID NO: 72050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agctgctgacaaaattctta

SEQ ID NO: 72051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttagctgctgacaaaattc

SEQ ID NO: 72052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atggatctccttagctgctg

SEQ ID NO: 72053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catggatctccttagctgct

SEQ ID NO: 72054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatggatctccttagctgc

SEQ ID NO: 72055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctttcatggatctcctta

SEQ ID NO: 72056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtcaatggctgacctttc

SEQ ID NO: 72057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtcaatggctgaccttt

SEQ ID NO: 72058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttaaagtcaatggctgac

SEQ ID NO: 72059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttaaagtcaatggctga

SEQ ID NO: 72060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatttaaagtcaatggctg

SEQ ID NO: 72061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcatttaaagtcaatggc

SEQ ID NO: 72062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcatttaaagtcaatgg

SEQ ID NO: 72063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttcatttaaagtcaatg

SEQ ID NO: 72064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttcatttaaagtcaat

SEQ ID NO: 72065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttctttcatttaaagt

SEQ ID NO: 72066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcatttttctttcatttaa

SEQ ID NO: 72067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgttcatttttctttcat

SEQ ID NO: 72068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acctgttcatttttctttca

SEQ ID NO: 72069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacctgttcatttttcttt

SEQ ID NO: 72070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttacctgttcatttttctt

SEQ ID NO: 72071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcttacctgttcattttt

SEQ ID NO: 72072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaggaattatttcttacct

SEQ ID NO: 72073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaggaattatttcttacc

SEQ ID NO: 72074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatttatgaggaattattt

SEQ ID NO: 72075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacatttatgaggaattatt

SEQ ID NO: 72076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaacatttatgaggaatta

SEQ ID NO: 72077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaacatttatgaggaatt

SEQ ID NO: 72078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcttaacatttatgagga

SEQ ID NO: 72079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaattatttcttaacattta

SEQ ID NO: 72080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaattatttcttaacatt

SEQ ID NO: 72081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgaaattatttcttaacat

SEQ ID NO: 72082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggaaagtcaaccaaagact

SEQ ID NO: 72083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggagctggggaaagtcaac

SEQ ID NO: 72084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caggagctggggaaagtcaa

SEQ ID NO: 72085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagcacttcaggagctgggg

SEQ ID NO: 72086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtgttaaagcacttcagga

SEQ ID NO: 72087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggtgttaaagcacttcag

SEQ ID NO: 72088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattctaggtgttaaagcac

SEQ ID NO: 72089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggattctaggtgttaaagca

SEQ ID NO: 72090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaataaaacttggattcta

SEQ ID NO: 72091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcagaataaaacttggattc

SEQ ID NO: 72092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctcagaataaaacttgga

SEQ ID NO: 72093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcagacagttgctctcagaa

SEQ ID NO: 72094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctggcagacagttgctctc

SEQ ID NO: 72095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caattgcctggcagacagtt

SEQ ID NO: 72096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaactccaattgcctggca

SEQ ID NO: 72097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattataaactccaattgc

SEQ ID NO: 72098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaagattaaaattataaa

SEQ ID NO: 72099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagaagattaaaattataa

SEQ ID NO: 72100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcacccatttaaagaagatt

SEQ ID NO: 72101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtcacccatttaaagaaga

SEQ ID NO: 72102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actctgtcacccatttaaag

SEQ ID NO: 72103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actaactctgtcacccattt

SEQ ID NO: 72104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taactaactctgtcacccat

SEQ ID NO: 72105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaactaactctgtcaccca

SEQ ID NO: 72106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaactaactctgtcaccc

SEQ ID NO: 72107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctaactaactctgtcacc

SEQ ID NO: 72108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctaactaactctgtcac

SEQ ID NO: 72109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctaactaactctgtca

SEQ ID NO: 72110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttttttctaactaactctg

SEQ ID NO: 72111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtcacctatttttttctaa

SEQ ID NO: 72112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actcagtcacctattttttt

SEQ ID NO: 72113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatcatatggaaagggaaa

SEQ ID NO: 72114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtatcatatggaaagggaa

SEQ ID NO: 72115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtttagtatcatatggaaa

SEQ ID NO: 72116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggagcaggcatctaggttt

SEQ ID NO: 72117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggagcaggcatctaggtt

SEQ ID NO: 72118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaggagcaggcatctaggt

SEQ ID NO: 72119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaggagcaggcatctagg

SEQ ID NO: 72120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacgtatgccttttaaggag

SEQ ID NO: 72121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaatcagattccacgtat

SEQ ID NO: 72122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagttagaaaatcagattcc

SEQ ID NO: 72123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagttagaaaatcagattc

SEQ ID NO: 72124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcttaaagttagaaaatca

SEQ ID NO: 72125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcttaaagttagaaaatc

SEQ ID NO: 72126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttcagcttaaagttagaa

SEQ ID NO: 72127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaccgtgttcatttcagct

SEQ ID NO: 72128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaccgtgttcatttcagc

SEQ ID NO: 72129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaccgtgttcatttcag

SEQ ID NO: 72130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaaattttaaaaccgtgt

SEQ ID NO: 72131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catggaagaagtaatactcc

SEQ ID NO: 72132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacatggaagaagtaatact

SEQ ID NO: 72133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgttctacatggaagaa

SEQ ID NO: 72134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatgttctacatggaaga

SEQ ID NO: 72135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatgttctacatggaag

SEQ ID NO: 72136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatattttaaaatgttctac

SEQ ID NO: 72137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatattttaaaatgttcta

SEQ ID NO: 72138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtatattttaaaatgtt

SEQ ID NO: 72139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgtatattttaaaatgt

SEQ ID NO: 72140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttgtatattttaaaatg

SEQ ID NO: 72141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattttatttgtatatttta

SEQ ID NO: 72142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagatgtgggacccagggat

SEQ ID NO: 72143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacagatgtgggacccaggg

SEQ ID NO: 72144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actctacagatgtgggaccc

SEQ ID NO: 72145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttgactctacagatgtggg

SEQ ID NO: 72146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagttggttgactctacaga

SEQ ID NO: 72147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catctgtagttggttgactc

SEQ ID NO: 72148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatctgtagttggttgact

SEQ ID NO: 72149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatctgtagttggttgac

SEQ ID NO: 72150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttccatctgtagttggtt

SEQ ID NO: 72151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caattattttccatctgtag

SEQ ID NO: 72152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaattattttccatctgta

SEQ ID NO: 72153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaattattttccatctgt

SEQ ID NO: 72154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccaattattttccatctg

SEQ ID NO: 72155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccaattattttccatct

SEQ ID NO: 72156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttccaattattttcca

SEQ ID NO: 72157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttccaattattttcc

SEQ ID NO: 72158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttattttttccaattat

SEQ ID NO: 72159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttattttttccaatta

SEQ ID NO: 72160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatttattttttccaatt

SEQ ID NO: 72161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatatttattttttccaat

SEQ ID NO: 72162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttatatttatttttt

SEQ ID NO: 72163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtatttttatatttattt

SEQ ID NO: 72164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgttgtatttttatattta

SEQ ID NO: 72165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgttgtatttttatattt

SEQ ID NO: 72166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgttgtatttttatatt

SEQ ID NO: 72167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattgttgtatttttatat

SEQ ID NO: 72168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttttattgttgtattttta

SEQ ID NO: 72169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactatttttattgttgtat

SEQ ID NO: 72170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtactatttttattgttgta

SEQ ID NO: 72171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtactatttttattgtt

SEQ ID NO: 72172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgtactatttttattgt

SEQ ID NO: 72173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttgtactatttttattg

SEQ ID NO: 72174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttgtactatttttatt

SEQ ID NO: 72175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatttgtactatttttat

SEQ ID NO: 72176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattttttatttgtactatt

SEQ ID NO: 72177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatattttttatttgtact

SEQ ID NO: 72178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actatattttttatttgtac

SEQ ID NO: 72179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactatattttttatttgta

SEQ ID NO: 72180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttactatattttttattt

SEQ ID NO: 72181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttactatattttttatt

SEQ ID NO: 72182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acacaatgtaaatatttgtt

SEQ ID NO: 72183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatgtaaaagtaaatcact

SEQ ID NO: 72184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataatgtaaaagtaaatcac

SEQ ID NO: 72185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttataatgtaaaagtaaat

SEQ ID NO: 72186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agattacttataatgtaaaa

SEQ ID NO: 72187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagattacttataatgtaaa

SEQ ID NO: 72188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttcagattacttataatg

SEQ ID NO: 72189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattatcttcagattactta

SEQ ID NO: 72190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattatcttcagattactt

SEQ ID NO: 72191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaattatcttcagattact

SEQ ID NO: 72192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atatgtacactttaaattat

SEQ ID NO: 72193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatatgtacactttaaatt

SEQ ID NO: 72194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacacatcctctcatatgta

SEQ ID NO: 72195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccataaaacctacacacatc

SEQ ID NO: 72196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accataaaacctacacacat

SEQ ID NO: 72197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataaaatggcacaatgttt

SEQ ID NO: 72198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atataaaatggcacaatgtt

SEQ ID NO: 72199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatataaaatggcacaatgt

SEQ ID NO: 72200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttatataaaatggcacaa

SEQ ID NO: 72201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aattcctttatataaaatgg

SEQ ID NO: 72202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagatgctcaattcctttat

SEQ ID NO: 72203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatctgcagatgctcaatt

SEQ ID NO: 72204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggccccccacagagacta

SEQ ID NO: 72205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaggccccccacagagact

SEQ ID NO: 72206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgggcgagtagtttgaaggc

SEQ ID NO: 72207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gatatctatgggcgagtagt

SEQ ID NO: 72208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtcatccctcgatatctatg

SEQ ID NO: 72209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagacggtaaagtaaggaa

SEQ ID NO: 72210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaagacggtaaagtaagga

SEQ ID NO: 72211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaagacggtaaagtaagg

SEQ ID NO: 72212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccaagacggtaaagtaag

SEQ ID NO: 72213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccaagacggtaaagtaa

SEQ ID NO: 72214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtagccaaggacatttttt

SEQ ID NO: 72215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgtagccaaggacatttt

SEQ ID NO: 72216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatgtagccaaggacattt

SEQ ID NO: 72217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataaataaatcatgatata

SEQ ID NO: 72218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtgaataaatgattaaata

SEQ ID NO: 72219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgagtgaataaatgatta

SEQ ID NO: 72220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattgagtgaataaatgatt

SEQ ID NO: 72221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatttaattgagtgaataaa

SEQ ID NO: 72222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatatttaattgagtgaata

SEQ ID NO: 72223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacaaaataaaataaaatg

SEQ ID NO: 72224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaaaacaaaataaaata

SEQ ID NO: 72225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaaattaaaacaaaata

SEQ ID NO: 72226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatacataagattaaattaa

SEQ ID NO: 72227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaaatacataagattaa

SEQ ID NO: 72228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaaaaatcaatacataag

SEQ ID NO: 72229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctcaaaaaaaatcaataca

SEQ ID NO: 72230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtctcaaaaaaaatcaata

SEQ ID NO: 72231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagagtgagactctgtctca

SEQ ID NO: 72232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gactacagagtgagactctg

SEQ ID NO: 72233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggactacagagtgagactct

SEQ ID NO: 72234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcttggactacagagtga

SEQ ID NO: 72235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactccagcttggactacag

SEQ ID NO: 72236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtaagccaagatcgcacc

SEQ ID NO: 72237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagaggcggaggttgcagta

SEQ ID NO: 72238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agctccagaggcggaggttg

SEQ ID NO: 72239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagctccagaggcggaggtt

SEQ ID NO: 72240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcatgagaatcacttgag

SEQ ID NO: 72241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggaggctgaggcatgagaa

SEQ ID NO: 72242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatatatatatatatatat

SEQ ID NO: 72243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatggaataatcatgactga

SEQ ID NO: 72244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaacgagattatatggaa

SEQ ID NO: 72245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaaaacgagattatatgga

SEQ ID NO: 72246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtggacttggaaaacgag

SEQ ID NO: 72247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagtggacttggaaaacga

SEQ ID NO: 72248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgaatttatagtggactt

SEQ ID NO: 72249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caccctccatgaatttatag

SEQ ID NO: 72250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agactccaccctccatgaat

SEQ ID NO: 72251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaagactccaccctccatg

SEQ ID NO: 72252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actaagactccaccctccat

SEQ ID NO: 72253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttactaagactccaccct

SEQ ID NO: 72254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacttactaagactccaccc

SEQ ID NO: 72255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttaacttactaagactcca

SEQ ID NO: 72256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctccttaacttactaagac

SEQ ID NO: 72257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatctccttaacttactaag

SEQ ID NO: 72258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatctccttaacttactaa

SEQ ID NO: 72259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaaatatcttctatctcct

SEQ ID NO: 72260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accaaatatcttctatctcc

SEQ ID NO: 72261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagatatttaccaaatatc

SEQ ID NO: 72262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacagatatttaccaaatat

SEQ ID NO: 72263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaagtatttgacagatatt

SEQ ID NO: 72264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgttagaaagtatttgaca

SEQ ID NO: 72265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctcatgttagaaagtattt

SEQ ID NO: 72266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagctcatgttagaaagtat

SEQ ID NO: 72267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctagctcatgttagaaagt

SEQ ID NO: 72268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctagctcatgttagaaag

SEQ ID NO: 72269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctagctcatgttagaaa

SEQ ID NO: 72270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttctctagctcatgttag

SEQ ID NO: 72271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttctctagctcatgtta

SEQ ID NO: 72272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttctctagctcatgtt

SEQ ID NO: 72273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgttttctctagctcatgt

SEQ ID NO: 72274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaataatcttttgttttct

SEQ ID NO: 72275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaataatcttttgttttc

SEQ ID NO: 72276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggcatcatttaaaaataat

SEQ ID NO: 72277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaggcatcatttaaaaataa

SEQ ID NO: 72278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtcttaaggcatcattta

SEQ ID NO: 72279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagtcttaaggcatcattt

SEQ ID NO: 72280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaagtcttaaggcatcatt

SEQ ID NO: 72281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttcaagtcttaaggcatc

SEQ ID NO: 72282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagattgctttcaagtctt

SEQ ID NO: 72283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgagattgctttcaagtct

SEQ ID NO: 72284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgagattgctttcaagtc

SEQ ID NO: 72285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatgagattgctttcaagt

SEQ ID NO: 72286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttttatgagattgctttca

SEQ ID NO: 72287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaattacttttatgagatt

SEQ ID NO: 72288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaaatataacaaccgtatt

SEQ ID NO: 72289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtgaaatataacaaccgt

SEQ ID NO: 72290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgtgaaatataacaaccg

SEQ ID NO: 72291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgtgaaatataacaacc

SEQ ID NO: 72292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattgtgaaatataacaac

SEQ ID NO: 72293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttattgtgaaatataac

SEQ ID NO: 72294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttattgtgaaatataa

SEQ ID NO: 72295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttttattgtgaaatata

SEQ ID NO: 72296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttttatttttattgtgaa

SEQ ID NO: 72297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgagtcaaggtatgtattg

SEQ ID NO: 72298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagtgagtcaaggtatgtat

SEQ ID NO: 72299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagtgagtcaaggtatgta

SEQ ID NO: 72300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catatttctagtgagtcaag

SEQ ID NO: 72301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgcatatttctagtgagt

SEQ ID NO: 72302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acctgcatatttctagtgag

SEQ ID NO: 72303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccacccttacctgcatattt

SEQ ID NO: 72304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcccacccttacctgcatat

SEQ ID NO: 72305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctcccacccttacctgca

SEQ ID NO: 72306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgccctcctctcccaccctt

SEQ ID NO: 72307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgccctcctctcccaccct

SEQ ID NO: 72308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgccctcctctcccaccc

SEQ ID NO: 72309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgccctcctctcccacc

SEQ ID NO: 72310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtgccctcctctcccac

SEQ ID NO: 72311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgtgccctcctctccca

SEQ ID NO: 72312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttgtgccctcctctccc

SEQ ID NO: 72313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacctttttttgtgccctc

SEQ ID NO: 72314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacctttttttgtgccct

SEQ ID NO: 72315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaacctttttttgtgccc

SEQ ID NO: 72316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttaaaacctttttttgtgc

SEQ ID NO: 72317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaacaggaactctttaaaa

SEQ ID NO: 72318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgagaacaggaactcttt

SEQ ID NO: 72319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaattcattgagaacagga

SEQ ID NO: 72320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtatgcatcaaatagtac

SEQ ID NO: 72321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaattatggtatgcatca

SEQ ID NO: 72322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaaattatggtatgcatc

SEQ ID NO: 72323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagaaattatggtatgcat

SEQ ID NO: 72324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagaaattatggtatgca

SEQ ID NO: 72325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagaaattatggtatgc

SEQ ID NO: 72326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttttgagaaattatggt

SEQ ID NO: 72327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttttgagaaattatgg

SEQ ID NO: 72328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattttttgagaaattatg

SEQ ID NO: 72329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattttaattttttgagaaa

SEQ ID NO: 72330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaattttaattttttgagaa

SEQ ID NO: 72331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtaatcttaaattttaatt

SEQ ID NO: 72332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gattcagtaatcttaaattt

SEQ ID NO: 72333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggattcagtaatcttaaa

SEQ ID NO: 72334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctggattcagtaatcttaa

SEQ ID NO: 72335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcctggattcagtaatctt

SEQ ID NO: 72336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttcctggattcagtaatct

SEQ ID NO: 72337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacttcttcctggattcagt

SEQ ID NO: 72338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacttcttcctggattcag

SEQ ID NO: 72339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatacttcttcctggattca

SEQ ID NO: 72340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaccgcaaacaattttatac

SEQ ID NO: 72341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaccgcaaacaattttata

SEQ ID NO: 72342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaccgcaaacaattttat

SEQ ID NO: 72343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaccgcaaacaatttta

SEQ ID NO: 72344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttttgaaccgcaaacaat

SEQ ID NO: 72345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatttttgaaccgcaaaca

SEQ ID NO: 72346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcatttttgaaccgcaaac

SEQ ID NO: 72347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccaaatggatgtagtccct

SEQ ID NO: 72348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccccaaatggatgtagtcc

SEQ ID NO: 72349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccccaaatggatgtagtc

SEQ ID NO: 72350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttctccccaaatggatgt

SEQ ID NO: 72351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaatttctccccaaatgga

SEQ ID NO: 72352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atccctcctaatttctcccc

SEQ ID NO: 72353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catccctcctaatttctccc

SEQ ID NO: 72354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcatccctcctaatttct

SEQ ID NO: 72355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcatccctcctaatttc

SEQ ID NO: 72356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatttcatccctcctaat

SEQ ID NO: 72357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaatgttatttatttcatc

SEQ ID NO: 72358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaaatgttatttatttca

SEQ ID NO: 72359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatgttctcaaaatgttatt

SEQ ID NO: 72360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaccatactcaatgttctc

SEQ ID NO: 72361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaccatactcaatgttct

SEQ ID NO: 72362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atacatgtaaaatgtttaga

SEQ ID NO: 72363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acacgttaatacatgtaaaa

SEQ ID NO: 72364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgaattaacacgttaata

SEQ ID NO: 72365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtcagggttaaatgaatta

SEQ ID NO: 72366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcgcagttgggtcagggt

SEQ ID NO: 72367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatcgcagttgggtcaggg

SEQ ID NO: 72368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atacttaaatcgcagttggg

SEQ ID NO: 72369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaatacttaaatcgcagtt

SEQ ID NO: 72370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgttaatacttaaatcg

SEQ ID NO: 72371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaaattgttaatacttaaa

SEQ ID NO: 72372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatctattaaattgttaat

SEQ ID NO: 72373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcatctattaaattgttaa

SEQ ID NO: 72374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttatcatctattaaatt

SEQ ID NO: 72375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtatttatcatctattaaat

SEQ ID NO: 72376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggcatcacccttgtattt

SEQ ID NO: 72377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaggcatcacccttgtatt

SEQ ID NO: 72378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagtcaaaatccttcaaggc

SEQ ID NO: 72379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccagtcaaaatccttcaag

SEQ ID NO: 72380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctccagtcaaaatccttcaa

SEQ ID NO: 72381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctccagtcaaaatcctt

SEQ ID NO: 72382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttctccagtcaaaatcct

SEQ ID NO: 72383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggatttccttctccagtcaa

SEQ ID NO: 72384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggatttccttctccagtca

SEQ ID NO: 72385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgggatttccttctccag

SEQ ID NO: 72386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttgggatttccttctcca

SEQ ID NO: 72387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcttgggatttccttctcc

SEQ ID NO: 72388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacactttgcttgggatttc

SEQ ID NO: 72389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccacactttgcttgggatt

SEQ ID NO: 72390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtcataaacactctccaca

SEQ ID NO: 72391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtcataaacactctccac

SEQ ID NO: 72392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggtcataaacactctcca

SEQ ID NO: 72393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaggtcataaacactctcc

SEQ ID NO: 72394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttttaggtcataaacactc

SEQ ID NO: 72395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttttaggtcataaacact

SEQ ID NO: 72396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taccaaaccaatttcctttt

SEQ ID NO: 72397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgtaccaaaccaatttcc

SEQ ID NO: 72398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctgtaccaaaccaatttc

SEQ ID NO: 72399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacctgtaccaaaccaattt

SEQ ID NO: 72400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacctgtaccaaaccaatt

SEQ ID NO: 72401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acccatagatttttacctgt

SEQ ID NO: 72402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgctcacccatagattttt

SEQ ID NO: 72403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctagtgctcacccatagatt

SEQ ID NO: 72404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctcctagtgctcacccata

SEQ ID NO: 72405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatctcctagtgctcaccca

SEQ ID NO: 72406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accagctctatctcctagtg

SEQ ID NO: 72407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaccagctctatctcctagt

SEQ ID NO: 72408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaccagctctatctcctag

SEQ ID NO: 72409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
accagctttgaccagctcta

SEQ ID NO: 72410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggccctaaccagctttgac

SEQ ID NO: 72411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acactatggccctaaccagc

SEQ ID NO: 72412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacactatggccctaaccag

SEQ ID NO: 72413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcacaaagccttcacacta

SEQ ID NO: 72414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtactgtgcacaaagcctt

SEQ ID NO: 72415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gaattatgtactgtgcacaa

SEQ ID NO: 72416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccatccccaaagtctcgaa

SEQ ID NO: 72417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggagtgagccaccacgcc

SEQ ID NO: 72418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agattacaggagtgagccac

SEQ ID NO: 72419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgagattacaggagtgagc

SEQ ID NO: 72420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccagttgctgagattacag

SEQ ID NO: 72421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccagttgctgagattaca

SEQ ID NO: 72422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccccagttgctgagattac

SEQ ID NO: 72423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccccagttgctgagatta

SEQ ID NO: 72424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttccccagttgctgagatt

SEQ ID NO: 72425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaactttttccccagttgct

SEQ ID NO: 72426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaactttttccccagttgc

SEQ ID NO: 72427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcaaactttttccccagtt

SEQ ID NO: 72428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggcaattcttcaaactttt

SEQ ID NO: 72429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gactcaggcaattcttcaaa

SEQ ID NO: 72430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctggactcaggcaattcttc

SEQ ID NO: 72431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaactactggactcaggcaa

SEQ ID NO: 72432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtctcaaactactggactca

SEQ ID NO: 72433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaggctggtctcaaactac

SEQ ID NO: 72434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccaggctggtctcaaacta

SEQ ID NO: 72435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtttcccaggctggtctca

SEQ ID NO: 72436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actatgtttcccaggctggt

SEQ ID NO: 72437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactatgtttcccaggctgg

SEQ ID NO: 72438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagagacaaggtttcactat

SEQ ID NO: 72439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagagacaaggtttcacta

SEQ ID NO: 72440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaagtttgtagagacaag

SEQ ID NO: 72441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaagtttgtagagacaa

SEQ ID NO: 72442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaagtttgtagagaca

SEQ ID NO: 72443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaaagtttgtagagac

SEQ ID NO: 72444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaaaagtttgtagaga

SEQ ID NO: 72445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaaaaagtttgtagag

SEQ ID NO: 72446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttttttaaaaaagtttgt

SEQ ID NO: 72447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacacccatgccacaacacc

SEQ ID NO: 72448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggactacacacccatgccac

SEQ ID NO: 72449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgggactacacacccatgc

SEQ ID NO: 72450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttgctgggactacacacc

SEQ ID NO: 72451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgagttgctgggactacac

SEQ ID NO: 72452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacctcctgagttgctggga

SEQ ID NO: 72453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctccacctcctgagttgct

SEQ ID NO: 72454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcctccacctcctgagtt

SEQ ID NO: 72455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagtgatcctcctgcctcca

SEQ ID NO: 72456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggctcaagtgatcctcctgc

SEQ ID NO: 72457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgggctcaagtgatcctcc

SEQ ID NO: 72458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactcctgggctcaagtgat

SEQ ID NO: 72459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaactcctgggctcaagtga

SEQ ID NO: 72460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaccttgaactcctgggct

SEQ ID NO: 72461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgcaaccttgaactcctgg

SEQ ID NO: 72462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgcaaccttgaactcctg

SEQ ID NO: 72463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcatagcttactgcaacctt

SEQ ID NO: 72464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtacagtggtgctatcat

SEQ ID NO: 72465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccagtctggagtacagtgg

SEQ ID NO: 72466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgcccagtctggagtacag

SEQ ID NO: 72467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttgcccagtctggagtac

SEQ ID NO: 72468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actctgttgcccagtctgga

SEQ ID NO: 72469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaacggagacaggtctca

SEQ ID NO: 72470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaacggagacaggtctc

SEQ ID NO: 72471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaacggagacaggtct

SEQ ID NO: 72472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaaacggagacaggtc

SEQ ID NO: 72473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaaaacggagacaggt

SEQ ID NO: 72474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaaaaacggagacagg

SEQ ID NO: 72475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaaaaaacggagacag

SEQ ID NO: 72476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttaaaaaacggagaca

SEQ ID NO: 72477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttttaaaaaacggaga

SEQ ID NO: 72478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttttttaaaaaacggag

SEQ ID NO: 72479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcttttttttaaaaaacgg

SEQ ID NO: 72480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttcttttttttaaaaaac

SEQ ID NO: 72481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctcttcttttttttaaaaa

SEQ ID NO: 72482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctcttcttttttttaaa

SEQ ID NO: 72483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctcttctttttttta

SEQ ID NO: 72484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctctcttcttttttt

SEQ ID NO: 72485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctctctcttcttttt

SEQ ID NO: 72486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctctctctctcttcttt

SEQ ID NO: 72487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgatgtatccatgatccgc

SEQ ID NO: 72488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatgatgtatccatgatcc

SEQ ID NO: 72489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actctcatgatgtatccatg

SEQ ID NO: 72490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactctcatgatgtatccat

SEQ ID NO: 72491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcatttcactctcatgatg

SEQ ID NO: 72492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtcctaatcatttcactct

SEQ ID NO: 72493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgcagattcagtcctaatc

SEQ ID NO: 72494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gctcatgcagattcagtcct

SEQ ID NO: 72495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgctcatgcagattcagtcc

SEQ ID NO: 72496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgctcatgcagattcagtc

SEQ ID NO: 72497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcgctcatgcagattca

SEQ ID NO: 72498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attattttcgctcatgcaga

SEQ ID NO: 72499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattattttcgctcatgcag

SEQ ID NO: 72500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgattattttcgctcatg

SEQ ID NO: 72501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttgattattttcgctcat

SEQ ID NO: 72502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttatttgattattttcgct

SEQ ID NO: 72503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttatttgattattttcgc

SEQ ID NO: 72504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttacttatttgattattt

SEQ ID NO: 72505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagtttacttatttgattat

SEQ ID NO: 72506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctagtttacttatttgat

SEQ ID NO: 72507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actctagtttacttatttga

SEQ ID NO: 72508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catttactctagtttactta

SEQ ID NO: 72509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatttactctagtttactt

SEQ ID NO: 72510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcatttactctagtttact

SEQ ID NO: 72511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattttgcatttactctagt

SEQ ID NO: 72512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccattttgcatttactctag

SEQ ID NO: 72513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttccattttgcatttactc

SEQ ID NO: 72514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcttccattttgcatttac

SEQ ID NO: 72515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgcctctgcttccattttg

SEQ ID NO: 72516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aactgatgcctctgcttcca

SEQ ID NO: 72517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagcagagtctcaactgatg

SEQ ID NO: 72518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagcagagtctcaactgat

SEQ ID NO: 72519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaccatttcaagcagagtct

SEQ ID NO: 72520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctaaaccatttcaagcaga

SEQ ID NO: 72521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctaaaccatttcaagcag

SEQ ID NO: 72522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcctaaaccatttcaagca

SEQ ID NO: 72523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcctaaaccatttcaagc

SEQ ID NO: 72524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgcctaaaccatttcaag

SEQ ID NO: 72525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttttgcctaaaccatttc

SEQ ID NO: 72526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actactttttgcctaaacca

SEQ ID NO: 72527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactcactactttttgccta

SEQ ID NO: 72528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtactcactactttttgcct

SEQ ID NO: 72529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtactcactactttttgcc

SEQ ID NO: 72530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttgtactcactacttttt

SEQ ID NO: 72531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttgtactcactactttt

SEQ ID NO: 72532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctttgtactcactacttt

SEQ ID NO: 72533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcacctttcctttgtactc

SEQ ID NO: 72534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcacctttcctttgtact

SEQ ID NO: 72535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatcacctttcctttgtac

SEQ ID NO: 72536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcatcacctttcctttgta

SEQ ID NO: 72537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttttcatcacctttccttt

SEQ ID NO: 72538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccttttcatcacctttcct

SEQ ID NO: 72539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatccacctctccttttcat

SEQ ID NO: 72540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatccacctctccttttca

SEQ ID NO: 72541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgaatccacctctccttt

SEQ ID NO: 72542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacagtgcctgtttgaatcc

SEQ ID NO: 72543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctccacagtgcctgtttga

SEQ ID NO: 72544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacagtctccctccacagtg

SEQ ID NO: 72545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaagttacacagtctccct

SEQ ID NO: 72546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcagttgaaaagttacacag

SEQ ID NO: 72547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtcagttgaaaagttaca

SEQ ID NO: 72548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgtcagttgaaaagttac

SEQ ID NO: 72549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcccatgtttcctgtcagt

SEQ ID NO: 72550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catcccatgtttcctgtcag

SEQ ID NO: 72551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccatgcttcatcccatgttt

SEQ ID NO: 72552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccatgcttcatcccatgtt

SEQ ID NO: 72553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agccttcccatgcttcatcc

SEQ ID NO: 72554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagccttcccatgcttcatc

SEQ ID NO: 72555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagccttcccatgcttcat

SEQ ID NO: 72556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaggtatctttgagccttc

SEQ ID NO: 72557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatgagaaagctcaaaggta

SEQ ID NO: 72558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctgtatgagaaagctcaaa

SEQ ID NO: 72559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agctgtatgagaaagctcaa

SEQ ID NO: 72560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttagctgtatgagaaagct

SEQ ID NO: 72561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acttagctgtatgagaaagc

SEQ ID NO: 72562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcttacttagctgtatgag

SEQ ID NO: 72563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcttacttagctgtatga

SEQ ID NO: 72564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttaatcttacttagctgt

SEQ ID NO: 72565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataattgatttaatcttact

SEQ ID NO: 72566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aataattgatttaatcttac

SEQ ID NO: 72567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaataattgatttaatctt

SEQ ID NO: 72568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttcttaataattgatttaa

SEQ ID NO: 72569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctagttcttaataattgatt

SEQ ID NO: 72570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actagttcttaataattgat

SEQ ID NO: 72571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttactagttcttaataattg

SEQ ID NO: 72572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttactagttcttaataatt

SEQ ID NO: 72573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttactagttcttaataat

SEQ ID NO: 72574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtaaagttttcttactagtt

SEQ ID NO: 72575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctggtaaagttttcttac

SEQ ID NO: 72576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagattcatctggtaaagtt

SEQ ID NO: 72577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgaagattcatctggtaaa

SEQ ID NO: 72578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgaagattcatctggtaa

SEQ ID NO: 72579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacaacagcttcctgaagat

SEQ ID NO: 72580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acacaacagcttcctgaaga

SEQ ID NO: 72581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacacaacagcttcctgaag

SEQ ID NO: 72582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcgtgactttacacaacag

SEQ ID NO: 72583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgcgtgactttacacaaca

SEQ ID NO: 72584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgcgtgactttacacaac

SEQ ID NO: 72585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgcgtgactttacacaa

SEQ ID NO: 72586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgtagtgatggatagttt

SEQ ID NO: 72587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acattgcatgtagtgatgga

SEQ ID NO: 72588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacattgcatgtagtgatgg

SEQ ID NO: 72589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaacattgcatgtagtgat

SEQ ID NO: 72590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttaacattgcatgtagtga

SEQ ID NO: 72591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttaacattgcatgtagt

SEQ ID NO: 72592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcataagttcttcttaacat

SEQ ID NO: 72593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgtcataagttcttcttaa

SEQ ID NO: 72594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattgtcataagttcttctt

SEQ ID NO: 72595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattgtcataagttcttct

SEQ ID NO: 72596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatttctattgtcataagt

SEQ ID NO: 72597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatttctattgtcataag

SEQ ID NO: 72598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatgaaatgaatgaaaatt

SEQ ID NO: 72599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaattagtatgaaatgaat

SEQ ID NO: 72600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atattaacaattagtatgaa

SEQ ID NO: 72601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catattaacaattagtatga

SEQ ID NO: 72602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttcatattaacaattag

SEQ ID NO: 72603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtttcatattaacaatta

SEQ ID NO: 72604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgtttcatattaacaatt

SEQ ID NO: 72605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatactttgtgtttcatat

SEQ ID NO: 72606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catatactttgtgtttcata

SEQ ID NO: 72607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggatagtgaatacagcaaag

SEQ ID NO: 72608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcagtgattcggatagtgaa

SEQ ID NO: 72609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcagtgattcggatagtga

SEQ ID NO: 72610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggaacttagcagtgattcg

SEQ ID NO: 72611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaatatgaatgctgagga

SEQ ID NO: 72612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaaatatgaatgctgagg

SEQ ID NO: 72613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggaatccgatttggaaaat

SEQ ID NO: 72614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacctggggaatccgatttg

SEQ ID NO: 72615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acagtgacagtgccaattgc

SEQ ID NO: 72616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaatcccagcctcacagtg

SEQ ID NO: 72617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcacaatcccagcctcaca

SEQ ID NO: 72618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcacaatcccagcctcac

SEQ ID NO: 72619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggaagacagtgatggtca

SEQ ID NO: 72620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatggaagacagtgatggtc

SEQ ID NO: 72621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagcagcgtggacaaacac

SEQ ID NO: 72622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaagcagcgtggacaaaca

SEQ ID NO: 72623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaagcagcgtggacaaac

SEQ ID NO: 72624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaggaaaaagataaaatcag

SEQ ID NO: 72625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcaaggaaaaagataaaat

SEQ ID NO: 72626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcaaggaaaaagataaaa

SEQ ID NO: 72627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatgagcaaaggtcacaat

SEQ ID NO: 72628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgaaatgagcaaaggtcac

SEQ ID NO: 72629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgaaatgagcaaaggtca

SEQ ID NO: 72630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
accatacacttgctgaaatg

SEQ ID NO: 72631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaccatacacttgctgaaa

SEQ ID NO: 72632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaccatacacttgctgaa

SEQ ID NO: 72633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatttctaaccatacacttg

SEQ ID NO: 72634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaaggaaaactatatttct

SEQ ID NO: 72635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatactaagaaggaaaacta

SEQ ID NO: 72636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagggagataagacaagcag

SEQ ID NO: 72637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagggagataagacaagca

SEQ ID NO: 72638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaaagccaaagatttcca

SEQ ID NO: 72639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaaaagccaaagatttcc

SEQ ID NO: 72640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaaaaagccaaagatttc

SEQ ID NO: 72641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagcattttccaaaaagcc

SEQ ID NO: 72642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaagcattttccaaaaag

SEQ ID NO: 72643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctaaaagcattttccaaa

SEQ ID NO: 72644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctaaaagcattttccaa

SEQ ID NO: 72645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgtgaatttattctaaaagc

SEQ ID NO: 72646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acgtgaatttattctaaaag

SEQ ID NO: 72647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgaaacaaaccttacgtg

SEQ ID NO: 72648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagggaataaattatgtg

SEQ ID NO: 72649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaattaaaaagggaataaat

SEQ ID NO: 72650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtgactagaattaaaaag

SEQ ID NO: 72651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagattgcagtgactagaat

SEQ ID NO: 72652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgcaaacaacctccagatt

SEQ ID NO: 72653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaagaccctgatgcaaac

SEQ ID NO: 72654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagcaattgaagaagaccct

SEQ ID NO: 72655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acagcaattgaagaagaccc

SEQ ID NO: 72656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agacaatcttacagcaattg

SEQ ID NO: 72657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttcagacaatcttacagca

SEQ ID NO: 72658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttcagacaatcttacagc

SEQ ID NO: 72659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttagttcagacaatctta

SEQ ID NO: 72660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agctcatttagttcagacaa

SEQ ID NO: 72661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgagctcatttagttcaga

SEQ ID NO: 72662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattgagctcatttagttc

SEQ ID NO: 72663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attattgagctcatttagtt

SEQ ID NO: 72664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccttattattgagctcatt

SEQ ID NO: 72665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggccttattattgagctca

SEQ ID NO: 72666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggccttattattgagctc

SEQ ID NO: 72667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctggccttattattgag

SEQ ID NO: 72668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacctatttctggccttatt

SEQ ID NO: 72669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atataggtcctaaacctatt

SEQ ID NO: 72670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccaccctgatataggtcct

SEQ ID NO: 72671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccccaccctgatataggtc

SEQ ID NO: 72672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccccctctccccaccctgat

SEQ ID NO: 72673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taccccctctccccaccctg

SEQ ID NO: 72674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaccccctctccccaccc

SEQ ID NO: 72675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctaccccctctccccacc

SEQ ID NO: 72676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctctaccccctctcccc

SEQ ID NO: 72677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctatttctctaccccctct

SEQ ID NO: 72678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctccctatttctctacccc

SEQ ID NO: 72679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtctccctatttctctac

SEQ ID NO: 72680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgtctccctatttctcta

SEQ ID NO: 72681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttcctgtctccctattt

SEQ ID NO: 72682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttcctgtctccctatt

SEQ ID NO: 72683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatttcctgtctccctat

SEQ ID NO: 72684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatatttcctgtctcccta

SEQ ID NO: 72685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatatttcctgtctccct

SEQ ID NO: 72686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttatatttcctgtctc

SEQ ID NO: 72687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttatatttcctgtct

SEQ ID NO: 72688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttatatttcctgtc

SEQ ID NO: 72689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttattttttatatttcct

SEQ ID NO: 72690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttattttttatatttcc

SEQ ID NO: 72691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttattttttatatttc

SEQ ID NO: 72692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttattttattttttatat

SEQ ID NO: 72693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttattttattttttata

SEQ ID NO: 72694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggaaaagtgtacttatttta

SEQ ID NO: 72695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattcggaaaagtgtactta

SEQ ID NO: 72696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggcctatattcggaaaagt

SEQ ID NO: 72697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattgtggcctatattcgga

SEQ ID NO: 72698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattgtggcctatattcgg

SEQ ID NO: 72699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtttgtattgtggcctatat

SEQ ID NO: 72700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctggtttgtattgtggccta

SEQ ID NO: 72701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gttgctggtttgtattgtgg

SEQ ID NO: 72702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgttgctggtttgtattgtg

SEQ ID NO: 72703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccgtgtgtgaaaaggtgca

SEQ ID NO: 72704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atccgtgtgtgaaaaggtgc

SEQ ID NO: 72705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgtggtcttatccgtgtgt

SEQ ID NO: 72706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatgtggtcttatccgtgt

SEQ ID NO: 72707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctcatgtggtcttatccgt

SEQ ID NO: 72708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctctctcatgtggtcttat

SEQ ID NO: 72709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtctctctcatgtggtctt

SEQ ID NO: 72710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gcctctgtctctctcatgtg

SEQ ID NO: 72711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccctcgcctctgtctctctc

SEQ ID NO: 72712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggatacagtgatgaggagt

SEQ ID NO: 72713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtctagggatacagtgatga

SEQ ID NO: 72714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caggggctagtctagggata

SEQ ID NO: 72715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtctgcaggggctagtcta

SEQ ID NO: 72716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgagtctgcaggggctagt

SEQ ID NO: 72717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgctgagtctgcaggggct

SEQ ID NO: 72718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctgctgagtctgcagggg

SEQ ID NO: 72719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
accctctgctgctgagtctg

SEQ ID NO: 72720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtatggctgaccctctgct

SEQ ID NO: 72721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgggtatggctgaccctct

SEQ ID NO: 72722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgggtatggctgaccctc

SEQ ID NO: 72723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcctgggtatggctgaccc

SEQ ID NO: 72724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccatggtaattcttcctgg

SEQ ID NO: 72725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctccccatggtaattcttcc

SEQ ID NO: 72726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctccccatggtaattctt

SEQ ID NO: 72727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgctccccatggtaattc

SEQ ID NO: 72728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctctgctccccatggtaat

SEQ ID NO: 72729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaatgatgtaatgataatg

SEQ ID NO: 72730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaaatgatgtaatgataat

SEQ ID NO: 72731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagaaatgaacttagaaatg

SEQ ID NO: 72732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctacagaaatgaacttagaa

SEQ ID NO: 72733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgctacagaaatgaactta

SEQ ID NO: 72734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggcactactgctacagaaa

SEQ ID NO: 72735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attaaggcactactgctaca

SEQ ID NO: 72736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gattaaggcactactgctac

SEQ ID NO: 72737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaaagagaacttgattaa

SEQ ID NO: 72738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggttcataaaagagaacttg

SEQ ID NO: 72739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggttcataaaagagaactt

SEQ ID NO: 72740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggttcataaaagagaact

SEQ ID NO: 72741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgggttcataaaagagaac

SEQ ID NO: 72742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgggttcataaaagagaa

SEQ ID NO: 72743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggagagttttttgggttcat

SEQ ID NO: 72744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaggtaataaagagtaatg

SEQ ID NO: 72745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcacaggtaataaagagtaa

SEQ ID NO: 72746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcacaggtaataaagagta

SEQ ID NO: 72747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttctcacaggtaataaaga

SEQ ID NO: 72748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctgtttctcacaggtaata

SEQ ID NO: 72749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacctgtttctcacaggtaa

SEQ ID NO: 72750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctacctgtttctcacagg

SEQ ID NO: 72751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttctacctgtttctcacag

SEQ ID NO: 72752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttctacctgtttctcaca

SEQ ID NO: 72753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttgttctacctgtttctc

SEQ ID NO: 72754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcacaatagaaaatagtcac

SEQ ID NO: 72755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcacaatagaaaatagtca

SEQ ID NO: 72756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagcacaatagaaaatagtc

SEQ ID NO: 72757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtaaagtgaacaaagatctt

SEQ ID NO: 72758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggtaaagtgaacaaagatc

SEQ ID NO: 72759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggtaaagtgaacaaagat

SEQ ID NO: 72760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttctggtaaagtgaacaa

SEQ ID NO: 72761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcttctggtaaagtgaaca

SEQ ID NO: 72762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaacaagtgacatttatctt

SEQ ID NO: 72763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttagaacaagtgacatttat

SEQ ID NO: 72764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttagaacaagtgacattta

SEQ ID NO: 72765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttgttagaacaagtgac

SEQ ID NO: 72766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgttccatttgttagaac

SEQ ID NO: 72767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagtattatgtgttccatt

SEQ ID NO: 72768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaagtattatgtgttccat

SEQ ID NO: 72769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtaagtattatgtgttcca

SEQ ID NO: 72770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggaactttgtaagtatta

SEQ ID NO: 72771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacaggaactttgtaagta

SEQ ID NO: 72772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attacaggaactttgtaagt

SEQ ID NO: 72773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattacaggaactttgtaag

SEQ ID NO: 72774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacagaatattttattacag

SEQ ID NO: 72775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggacagaatattttattaca

SEQ ID NO: 72776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggacagaatattttatta

SEQ ID NO: 72777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttggacagaatattttatt

SEQ ID NO: 72778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcacgcttcttggacagaat

SEQ ID NO: 72779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagcacgcttcttggacaga

SEQ ID NO: 72780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcagtattctagcacgctt

SEQ ID NO: 72781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtcacattaagcagtat

SEQ ID NO: 72782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagtcacattaagcagta

SEQ ID NO: 72783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaagtcacattaagcagt

SEQ ID NO: 72784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgctttaaaagtcacattaa

SEQ ID NO: 72785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgctttaaaagtcacatt

SEQ ID NO: 72786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtgctttaaaagtcacat

SEQ ID NO: 72787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtgctttaaaagtcaca

SEQ ID NO: 72788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctgtgctttaaaagtcac

SEQ ID NO: 72789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggggcaggtccttttctg

SEQ ID NO: 72790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgtgaatcaggttcaagg

SEQ ID NO: 72791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcatgtgaatcaggttca

SEQ ID NO: 72792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggcaaacataataggcaat

SEQ ID NO: 72793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagggcaaacataataggca

SEQ ID NO: 72794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctagggcaaacataataggc

SEQ ID NO: 72795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctagggcaaacataatag

SEQ ID NO: 72796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatctcttctagggcaaac

SEQ ID NO: 72797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaatctcttctagggcaaa

SEQ ID NO: 72798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaatctcttctagggcaa

SEQ ID NO: 72799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtaatctcttctagggca

SEQ ID NO: 72800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtaatctcttctagggc

SEQ ID NO: 72801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttgtaatctcttctaggg

SEQ ID NO: 72802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
accttttttgtaatctcttc

SEQ ID NO: 72803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcctgaccttttttgtaatc

SEQ ID NO: 72804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagagaatagaaattgtcct

SEQ ID NO: 72805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagagaatagaaattgtcc

SEQ ID NO: 72806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttcaagagaatagaaattg

SEQ ID NO: 72807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttcaagagaatagaaatt

SEQ ID NO: 72808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcttcaagagaatagaaat

SEQ ID NO: 72809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaaataaaactttgcttca

SEQ ID NO: 72810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actcagaaataaaactttgc

SEQ ID NO: 72811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgagaaaaaaaaataatt

SEQ ID NO: 72812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtgagaaaaaaaaataat

SEQ ID NO: 72813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttcagtgagaaaaaaaaat

SEQ ID NO: 72814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacttcagtgagaaaaaaaa

SEQ ID NO: 72815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctacttcagtgagaaaaaaa

SEQ ID NO: 72816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacttctacttcagtgagaa

SEQ ID NO: 72817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acctgcacttctacttcagt

SEQ ID NO: 72818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatgtggagttgacctgca

SEQ ID NO: 72819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaatgtggagttgacctgc

SEQ ID NO: 72820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaatgtggagttgacctg

SEQ ID NO: 72821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacaatgtggagttgacct

SEQ ID NO: 72822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttacaatgtggagttgacc

SEQ ID NO: 72823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttacaatgtggagttgac

SEQ ID NO: 72824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttacaatgtggagttga

SEQ ID NO: 72825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttacaatgtggagttg

SEQ ID NO: 72826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttacaatgtggagtt

SEQ ID NO: 72827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttacaatgtggagt

SEQ ID NO: 72828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttacaatgtggag

SEQ ID NO: 72829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaacattttttttttttac

SEQ ID NO: 72830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtgaacatttttttttttt

SEQ ID NO: 72831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccctctgtgaacattttttt

SEQ ID NO: 72832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgccctctgtgaacatttt

SEQ ID NO: 72833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgccctctgtgaacattt

SEQ ID NO: 72834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgtttcctgccctctgtg

SEQ ID NO: 72835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatgtttcctgccctctgt

SEQ ID NO: 72836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatttacatgtttcctgcc

SEQ ID NO: 72837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaatttacatgtttcctgc

SEQ ID NO: 72838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatataatttacaatttaca

SEQ ID NO: 72839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatataatttacaatttac

SEQ ID NO: 72840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gataaaacaatgtttaaata

SEQ ID NO: 72841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggataaaacaatgtttaa

SEQ ID NO: 72842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctggataaaacaatgttta

SEQ ID NO: 72843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcctggataaaacaatgt

SEQ ID NO: 72844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttcctggataaaacaatg

SEQ ID NO: 72845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttcctggataaaacaat

SEQ ID NO: 72846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtttcctggataaaacaa

SEQ ID NO: 72847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtttcctggataaaaca

SEQ ID NO: 72848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttgtttcctggataaaac

SEQ ID NO: 72849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttttttgtttcctggataa

SEQ ID NO: 72850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttttttgtttcctggata

SEQ ID NO: 72851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatttccttttttgtttcct

SEQ ID NO: 72852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catcaaatgccaattcaatt

SEQ ID NO: 72853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatcaaatgccaattcaat

SEQ ID NO: 72854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggccatgaaaagacttacat

SEQ ID NO: 72855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggccatgaaaagacttaca

SEQ ID NO: 72856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacatgaggtagatgattt

SEQ ID NO: 72857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacatgaggtagatgatt

SEQ ID NO: 72858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaacatgaggtagatgat

SEQ ID NO: 72859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaacatgaggtagatga

SEQ ID NO: 72860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gatttttaaaacatgaggta

SEQ ID NO: 72861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgatttttaaaacatgaggt

SEQ ID NO: 72862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttcgatttttaaaacatga

SEQ ID NO: 72863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acttcgatttttaaaacatg

SEQ ID NO: 72864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtcttacttcgatttttaa

SEQ ID NO: 72865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttaggtcttacttcgatt

SEQ ID NO: 72866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagttaggtcttacttcgat

SEQ ID NO: 72867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcagttaggtcttacttcg

SEQ ID NO: 72868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttcagttaggtcttactt

SEQ ID NO: 72869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcttcagttaggtcttact

SEQ ID NO: 72870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtatgaccaaaatgaggga

SEQ ID NO: 72871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtatgaccaaaatgaggg

SEQ ID NO: 72872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggtatgaccaaaatgagg

SEQ ID NO: 72873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttaggtatgaccaaaatg

SEQ ID NO: 72874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagaaattgttttaggtat

SEQ ID NO: 72875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catctcagagaaattgtttt

SEQ ID NO: 72876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatctcagagaaattgttt

SEQ ID NO: 72877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttacatctcagagaaattg

SEQ ID NO: 72878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttacatctcagagaaatt

SEQ ID NO: 72879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacttacatctcagagaaat

SEQ ID NO: 72880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctttacttacatctcagag

SEQ ID NO: 72881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgtctttacttacatctca

SEQ ID NO: 72882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcctgctgtctttacttaca

SEQ ID NO: 72883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcctgctgtctttacttac

SEQ ID NO: 72884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagcctgctgtctttactta

SEQ ID NO: 72885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacacacaattttagcctg

SEQ ID NO: 72886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgagacacacaattttagc

SEQ ID NO: 72887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgagacacacaattttag

SEQ ID NO: 72888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatcagacttattgagacac

SEQ ID NO: 72889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaaatcagacttattgaga

SEQ ID NO: 72890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctaaatcagacttattga

SEQ ID NO: 72891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcctaaatcagacttattg

SEQ ID NO: 72892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcctaaatcagacttatt

SEQ ID NO: 72893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagaattttctcctaaatca

SEQ ID NO: 72894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgacctccagaattttctcc

SEQ ID NO: 72895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagacctccgacctccaga

SEQ ID NO: 72896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgattcccagacctccgacc

SEQ ID NO: 72897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actatgattcccagacctcc

SEQ ID NO: 72898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcactatgattcccagacc

SEQ ID NO: 72899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaaattgttcactatgat

SEQ ID NO: 72900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaattatcaaaattgttca

SEQ ID NO: 72901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcaattatcaaaattgttc

SEQ ID NO: 72902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagcaattatcaaaattgtt

SEQ ID NO: 72903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagcaattatcaaaattgt

SEQ ID NO: 72904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agggatttttagcaattatc

SEQ ID NO: 72905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagggatttttagcaattat

SEQ ID NO: 72906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaccatttcagggattttta

SEQ ID NO: 72907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaaaccatttcagggattt

SEQ ID NO: 72908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaactattaaaccatttca

SEQ ID NO: 72909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgacaactattaaaccat

SEQ ID NO: 72910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgacaactattaaacca

SEQ ID NO: 72911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattgacaactattaaacc

SEQ ID NO: 72912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcattgacaactattaaac

SEQ ID NO: 72913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcattgacaactattaaa

SEQ ID NO: 72914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagtgaaatatactttttc

SEQ ID NO: 72915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catagtgaaatatacttttt

SEQ ID NO: 72916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacaaatatacacaaacat

SEQ ID NO: 72917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaaaacaaatatacacaaa

SEQ ID NO: 72918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattaaaacaaatatacac

SEQ ID NO: 72919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accaatattcctattaaaac

SEQ ID NO: 72920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caccaatattcctattaaaa

SEQ ID NO: 72921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agatcttcaccaatattcct

SEQ ID NO: 72922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagcagtaaaatggaccctc

SEQ ID NO: 72923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggagactaaagcagtaaaa

SEQ ID NO: 72924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacagattaaggagactaaa

SEQ ID NO: 72925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaacagattaaggagactaa

SEQ ID NO: 72926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acgcttgaacagattaagga

SEQ ID NO: 72927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacgcttgaacagattaagg

SEQ ID NO: 72928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatggtttaacgcttgaac

SEQ ID NO: 72929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaaaatggtttaacgcttg

SEQ ID NO: 72930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caccctgttaaaatggttta

SEQ ID NO: 72931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacgaagtgagaaccgcatg

SEQ ID NO: 72932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaacgaagtgagaaccgca

SEQ ID NO: 72933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctcaacgaagtgagaacc

SEQ ID NO: 72934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcacagcagctgttctcaac

SEQ ID NO: 72935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggaaagaaagttgtcaca

SEQ ID NO: 72936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaggaaagaaagttgtcac

SEQ ID NO: 72937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaggaaagaaagttgtca

SEQ ID NO: 72938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaggaaagaaagttgtc

SEQ ID NO: 72939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatttttgaaggaaagaaa

SEQ ID NO: 72940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgatttttgaaggaaagaa

SEQ ID NO: 72941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagacttatgatttttgaag

SEQ ID NO: 72942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagaaatattagagacttat

SEQ ID NO: 72943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggttatagaaatattagaga

SEQ ID NO: 72944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatacccactaggttatag

SEQ ID NO: 72945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgatacccactaggttata

SEQ ID NO: 72946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttgtgatacccactaggt

SEQ ID NO: 72947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttgtgatacccactagg

SEQ ID NO: 72948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatttgtgatacccactag

SEQ ID NO: 72949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgatttgtgatacccac

SEQ ID NO: 72950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttgatttgtgataccca

SEQ ID NO: 72951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattttgatttgtgataccc

SEQ ID NO: 72952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatgataatacaaagatga

SEQ ID NO: 72953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacatgataatacaaagatg

SEQ ID NO: 72954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaacatgataatacaaag

SEQ ID NO: 72955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttaacatgataatacaaa

SEQ ID NO: 72956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtttaacatgataataca

SEQ ID NO: 72957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttgtttaacatgataata

SEQ ID NO: 72958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcttgtttaacatgataat

SEQ ID NO: 72959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctcttgtttaacatgata

SEQ ID NO: 72960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctcttgtttaacatgat

SEQ ID NO: 72961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatttcttctcttgtttaa

SEQ ID NO: 72962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaatatttcttctcttgtt

SEQ ID NO: 72963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaatatttcttctcttgt

SEQ ID NO: 72964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattaatatttcttctcttg

SEQ ID NO: 72965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatcaagtatacattttatt

SEQ ID NO: 72966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatcaagtatacattttat

SEQ ID NO: 72967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaatcaagtatacatttta

SEQ ID NO: 72968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcaaaatgagactttgaat

SEQ ID NO: 72969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cgaagaccattaatcaaaat

SEQ ID NO: 72970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcgaagaccattaatcaaaa

SEQ ID NO: 72971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatcaggaaacttgcgaaga

SEQ ID NO: 72972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gggtctatatcaggaaactt

SEQ ID NO: 72973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcagctcgggtctatatca

SEQ ID NO: 72974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcagctcgggtctatatc

SEQ ID NO: 72975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtcagctcgggtctatat

SEQ ID NO: 72976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaaataagttttagtcag

SEQ ID NO: 72977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaaaataagttttagtca

SEQ ID NO: 72978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaaaacatttggaaaaata

SEQ ID NO: 72979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggaaaacatttggaaaaat

SEQ ID NO: 72980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggaccataggtttaggaaa

SEQ ID NO: 72981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatggttaaggaccatagg

SEQ ID NO: 72982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgaaatggttaaggacca

SEQ ID NO: 72983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccagttaattgaaatggtta

SEQ ID NO: 72984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgccagttaattgaaatgg

SEQ ID NO: 72985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgccagttaattgaaatg

SEQ ID NO: 72986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgccagttaattgaaat

SEQ ID NO: 72987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcattttattgccagttaa

SEQ ID NO: 72988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcattttattgccagtta

SEQ ID NO: 72989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatcattttattgccagtt

SEQ ID NO: 72990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgatcattttattgccagt

SEQ ID NO: 72991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgatcattttattgcca

SEQ ID NO: 72992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttttgatcattttattg

SEQ ID NO: 72993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcttttgatcattttatt

SEQ ID NO: 72994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttattcttttgatcattt

SEQ ID NO: 72995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatttattcttttgatcat

SEQ ID NO: 72996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaatttattcttttgatc

SEQ ID NO: 72997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctaatttattcttttgat

SEQ ID NO: 72998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttctctaatttattctt

SEQ ID NO: 72999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttctctaatttattct

SEQ ID NO: 73000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatttctctaatttattc

SEQ ID NO: 73001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatatttctctaatttatt

SEQ ID NO: 73002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatatttctctaatttat

SEQ ID NO: 73003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttatatttctctaattta

SEQ ID NO: 73004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttatatttctctaattt

SEQ ID NO: 73005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttttttatatttctctaat

SEQ ID NO: 73006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttttttatatttctcta

SEQ ID NO: 73007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctttttttatatttctct

SEQ ID NO: 73008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttctctttttttatattt

SEQ ID NO: 73009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactggcttctcttttttta

SEQ ID NO: 73010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgctaaactggcttctct

SEQ ID NO: 73011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagttatatgctaaactggc

SEQ ID NO: 73012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacattagagttatatgcta

SEQ ID NO: 73013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccacattagagttatatgct

SEQ ID NO: 73014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatagccttccacattaga

SEQ ID NO: 73015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgatatagccttccacatt

SEQ ID NO: 73016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggaaaaaaatatattcctg

SEQ ID NO: 73017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggaaaaaaatatattcct

SEQ ID NO: 73018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatttaaggaaaaaaatat

SEQ ID NO: 73019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaatatcatagaattaaaa

SEQ ID NO: 73020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atggaggaactaccaatatc

SEQ ID NO: 73021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actaatggaggaactaccaa

SEQ ID NO: 73022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gactaatggaggaactacca

SEQ ID NO: 73023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgactaatggaggaactac

SEQ ID NO: 73024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataaccaactcttgactaat

SEQ ID NO: 73025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaagttgataaccaactc

SEQ ID NO: 73026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaaagaaagtatacagaag

SEQ ID NO: 73027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcaaagaaagtatacagaa

SEQ ID NO: 73028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggcaaagaaagtatacag

SEQ ID NO: 73029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcttggcaaagaaagtat

SEQ ID NO: 73030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaattcttggcaaagaaag

SEQ ID NO: 73031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attattaattcttggcaaag

SEQ ID NO: 73032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattattaattcttggcaaa

SEQ ID NO: 73033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taattattaattcttggcaa

SEQ ID NO: 73034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaattattaattcttggc

SEQ ID NO: 73035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctttaattattaattctt

SEQ ID NO: 73036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattctttaattattaatt

SEQ ID NO: 73037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atattattattctttaatta

SEQ ID NO: 73038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actcatattattattcttta

SEQ ID NO: 73039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actaactcatattattattc

SEQ ID NO: 73040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgttaactaactcatatta

SEQ ID NO: 73041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtgtagaattagtgttaact

SEQ ID NO: 73042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcgtgtagaattagtgtt

SEQ ID NO: 73043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattcgtgtagaattagtgt

SEQ ID NO: 73044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgagtgtttcattcgtgta

SEQ ID NO: 73045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtaaaaaacagaggggat

SEQ ID NO: 73046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagtaaaaaacagagggga

SEQ ID NO: 73047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaggcaatatagatttata

SEQ ID NO: 73048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaggcaatatagatttat

SEQ ID NO: 73049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaaaggcaatatagattta

SEQ ID NO: 73050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttgaaaggcaatatagat

SEQ ID NO: 73051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttgaaaggcaatataga

SEQ ID NO: 73052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctttgaaaggcaatatag

SEQ ID NO: 73053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttttcctttgaaaggcaa

SEQ ID NO: 73054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgtgagagttatgttttcc

SEQ ID NO: 73055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcatggacactggtgtgag

SEQ ID NO: 73056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcatggacactggtgtga

SEQ ID NO: 73057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacaatggataatataatat

SEQ ID NO: 73058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaacaatggataatataata

SEQ ID NO: 73059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaacaatggataatataat

SEQ ID NO: 73060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtgggcctttgaacaatg

SEQ ID NO: 73061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagtgggcctttgaacaat

SEQ ID NO: 73062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagtgggcctttgaacaa

SEQ ID NO: 73063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaagtgggcctttgaaca

SEQ ID NO: 73064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agggaggtttttgaagtggg

SEQ ID NO: 73065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagggaggtttttgaagtgg

SEQ ID NO: 73066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacttaagggaggtttttg

SEQ ID NO: 73067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gattgagacttaagggaggt

SEQ ID NO: 73068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagattgagacttaagggag

SEQ ID NO: 73069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaaagagttctagattga

SEQ ID NO: 73070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagaaagagttctagattg

SEQ ID NO: 73071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acacttaaagaaagagttct

SEQ ID NO: 73072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgacacttaaagaaagagtt

SEQ ID NO: 73073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgacacttaaagaaagagt

SEQ ID NO: 73074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataaaatgcttctgacact

SEQ ID NO: 73075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaataaggttaaataaaat

SEQ ID NO: 73076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taccaataaggttaaataaa

SEQ ID NO: 73077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagacaaggaagaagtgat

SEQ ID NO: 73078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggcacagaaaagtggaaca

SEQ ID NO: 73079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagggcacagaaaagtgga

SEQ ID NO: 73080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attagggcacagaaaagtgg

SEQ ID NO: 73081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agatgcttattagggcacag

SEQ ID NO: 73082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagatgcttattagggcaca

SEQ ID NO: 73083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagatgcttattagggcac

SEQ ID NO: 73084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagatgcttattagggca

SEQ ID NO: 73085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttaagatgcttattagg

SEQ ID NO: 73086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttttaagatgcttattag

SEQ ID NO: 73087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atccttgtttttaagatgct

SEQ ID NO: 73088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccatggtctaatccttgtt

SEQ ID NO: 73089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggtggaagaccaaaaccaa

SEQ ID NO: 73090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggtggaagaccaaaacca

SEQ ID NO: 73091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttagggtggaagaccaaaa

SEQ ID NO: 73092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtattatttagggtggaag

SEQ ID NO: 73093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtattatttagggtggaa

SEQ ID NO: 73094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaggtattatttagggtg

SEQ ID NO: 73095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataggaaggcattgtttag

SEQ ID NO: 73096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agataggaaggcattgttta

SEQ ID NO: 73097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttagataggaaggcattgt

SEQ ID NO: 73098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtattgtttagataggaag

SEQ ID NO: 73099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtattgtttagataggaa

SEQ ID NO: 73100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaaaagaaaggtatttagg

SEQ ID NO: 73101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtgaaaagaaaggtattta

SEQ ID NO: 73102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgtgaaaagaaaggtatt

SEQ ID NO: 73103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctgtgaaaagaaaggtat

SEQ ID NO: 73104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatcttctctgtgaaaaga

SEQ ID NO: 73105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtatcttctctgtgaaaag

SEQ ID NO: 73106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtatcttctctgtgaaaa

SEQ ID NO: 73107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtatcttctctgtgaaa

SEQ ID NO: 73108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttagtatcttctctgtgaa

SEQ ID NO: 73109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatattttttagtatcttct

SEQ ID NO: 73110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactcaatattttttagtat

SEQ ID NO: 73111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccactcaatattttttagta

SEQ ID NO: 73112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccactcaatattttttagt

SEQ ID NO: 73113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accacattttccactcaata

SEQ ID NO: 73114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaccacattttccactcaa

SEQ ID NO: 73115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctctcaccacattttccac

SEQ ID NO: 73116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggctctcaccacattttcca

SEQ ID NO: 73117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttggctctcaccacattt

SEQ ID NO: 73118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagggaaaggcattccctt

SEQ ID NO: 73119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggcaaattcaaagggaaag

SEQ ID NO: 73120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaggcaaattcaaaggga

SEQ ID NO: 73121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcaggcaaattcaaaggg

SEQ ID NO: 73122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttattcaggcaaattcaaa

SEQ ID NO: 73123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatttattcaggcaaattc

SEQ ID NO: 73124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatttattcaggcaaatt

SEQ ID NO: 73125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgtttattatttattcag

SEQ ID NO: 73126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgtttattatttattca

SEQ ID NO: 73127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaaaacatgccacatcaaa

SEQ ID NO: 73128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgaaaacatgccacatcaa

SEQ ID NO: 73129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaaaggtataacttgtgaa

SEQ ID NO: 73130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acataaaatcgtgaaattgg

SEQ ID NO: 73131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacataaaatcgtgaaattg

SEQ ID NO: 73132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacataaaatcgtgaaatt

SEQ ID NO: 73133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaattttgacataaaatc

SEQ ID NO: 73134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaaaattttgacataaaat

SEQ ID NO: 73135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacaaaattttgacataaa

SEQ ID NO: 73136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttacaaaattttgacataa

SEQ ID NO: 73137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttacaaaattttgacat

SEQ ID NO: 73138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcttacaaaattttgaca

SEQ ID NO: 73139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcatttcttcttacaaaat

SEQ ID NO: 73140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgcccagctgtgcatttctt

SEQ ID NO: 73141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgcgcccagctgtgcattt

SEQ ID NO: 73142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggcgtgagctactgcgcc

SEQ ID NO: 73143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaattacaggcgtgagctac

SEQ ID NO: 73144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaagtgctagaattacag

SEQ ID NO: 73145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgtcgcctcccaaagtgcta

SEQ ID NO: 73146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggtgatccagcctccgtcg

SEQ ID NO: 73147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctcaggtgatccagcctc

SEQ ID NO: 73148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgacctcaggtgatccagc

SEQ ID NO: 73149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gaactcctgacctcaggtga

SEQ ID NO: 73150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtctcgaactcctgacctca

SEQ ID NO: 73151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccaggctggtctcgaactc

SEQ ID NO: 73152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtcatgttggccaggctggt

SEQ ID NO: 73153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgtcatgttggccaggctgg

SEQ ID NO: 73154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgtcatgttggccaggctg

SEQ ID NO: 73155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagagacaggttttcgtca

SEQ ID NO: 73156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagagacaggttttcgtc

SEQ ID NO: 73157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagagacaggttttcgt

SEQ ID NO: 73158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtagagacaggttttcg

SEQ ID NO: 73159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttagtagagacaggt

SEQ ID NO: 73160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttttagtagagacagg

SEQ ID NO: 73161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatttttagtagagacag

SEQ ID NO: 73162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtatttttagtagagaca

SEQ ID NO: 73163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttttgtatttttagtaga

SEQ ID NO: 73164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccgtgccagctaatttttgt

SEQ ID NO: 73165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggtgcatgctaccgtgcc

SEQ ID NO: 73166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agattacaggtgcatgctac

SEQ ID NO: 73167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtagctgagattacaggtg

SEQ ID NO: 73168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgagtagctgagattacag

SEQ ID NO: 73169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctcctgagtagctgaga

SEQ ID NO: 73170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagcctcctgagtagct

SEQ ID NO: 73171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcctcagcctcctgagtag

SEQ ID NO: 73172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgcctcagcctcctgagta

SEQ ID NO: 73173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctgcctcagcctcctgag

SEQ ID NO: 73174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagcaattcttctgcctcag

SEQ ID NO: 73175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaggttcaagcaattcttc

SEQ ID NO: 73176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacctcccaggttcaagcaa

SEQ ID NO: 73177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accccaacctccacctccca

SEQ ID NO: 73178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggctcaccccaacctccacc

SEQ ID NO: 73179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtgcaatgatgtgatctc

SEQ ID NO: 73180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccaggctggagtgcaatga

SEQ ID NO: 73181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgcccaggctggagtgcaa

SEQ ID NO: 73182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgcccaggctggagtgca

SEQ ID NO: 73183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttgcccaggctggagtgc

SEQ ID NO: 73184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gctttgttgcccaggctgga

SEQ ID NO: 73185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatggaatctcgctttgtt

SEQ ID NO: 73186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagatggaatctcgctttgt

SEQ ID NO: 73187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagatggaatctcgctttg

SEQ ID NO: 73188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagatggaatctcgcttt

SEQ ID NO: 73189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagatggaatctcgctt

SEQ ID NO: 73190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgagatggaatctcgct

SEQ ID NO: 73191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgagatggaatctcgc

SEQ ID NO: 73192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgagatggaatctcg

SEQ ID NO: 73193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttgagatggaatctc

SEQ ID NO: 73194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttgagatggaatct

SEQ ID NO: 73195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttgagatggaatc

SEQ ID NO: 73196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttgagatggaat

SEQ ID NO: 73197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttgagatggaa

SEQ ID NO: 73198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtattttttttttttttga

SEQ ID NO: 73199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgtattttttttttttttg

SEQ ID NO: 73200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgtgtatttttttttttt

SEQ ID NO: 73201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttgtgtattttttttttt

SEQ ID NO: 73202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagcaggatttgcttgtgta

SEQ ID NO: 73203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctatagcaggatttgcttgt

SEQ ID NO: 73204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagctcctatagcaggatt

SEQ ID NO: 73205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataagctcctatagcaggat

SEQ ID NO: 73206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttataagctcctatagc

SEQ ID NO: 73207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttataagctcctatag

SEQ ID NO: 73208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatttataagctcctata

SEQ ID NO: 73209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttgtatttataagctcct

SEQ ID NO: 73210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttttgtatttataagctc

SEQ ID NO: 73211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgttttgtatttataagc

SEQ ID NO: 73212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctgttttgtatttataag

SEQ ID NO: 73213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctctgttttgtatttata

SEQ ID NO: 73214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttctctgttttgtatttat

SEQ ID NO: 73215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttctctgttttgtattt

SEQ ID NO: 73216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcttctctgttttgtatt

SEQ ID NO: 73217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcttcttctctgttttgt

SEQ ID NO: 73218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttcttcttctctgttttg

SEQ ID NO: 73219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtttcttcttctctgtttt

SEQ ID NO: 73220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgtttcttcttctctgtt

SEQ ID NO: 73221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttgtttcttcttctctg

SEQ ID NO: 73222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caatatggaatgaaatgcac

SEQ ID NO: 73223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaatatggaatgaaatgca

SEQ ID NO: 73224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttccaatatggaatgaaat

SEQ ID NO: 73225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaattccttccaatatgga

SEQ ID NO: 73226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaaattccttccaatatgg

SEQ ID NO: 73227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatagccttacaaattcctt

SEQ ID NO: 73228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatagccttacaaattcct

SEQ ID NO: 73229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatagccttacaaattcc

SEQ ID NO: 73230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttttatatagccttacaaa

SEQ ID NO: 73231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctagttttatatagccttac

SEQ ID NO: 73232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctagttttatatagcctta

SEQ ID NO: 73233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtaataaataagcttcct

SEQ ID NO: 73234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagttgtagtaataaataag

SEQ ID NO: 73235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcaccctcaagttgtagta

SEQ ID NO: 73236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgatcaccctcaagttgta

SEQ ID NO: 73237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taattgttgatcaccctcaa

SEQ ID NO: 73238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataattgttgatcaccctc

SEQ ID NO: 73239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccattctataattgttgatc

SEQ ID NO: 73240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gattaccattctataattgt

SEQ ID NO: 73241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacaaaaaatatacatcctg

SEQ ID NO: 73242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgcacaaaaaatatacatc

SEQ ID NO: 73243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgcacaaaaaatatacat

SEQ ID NO: 73244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgcacaaaaaatataca

SEQ ID NO: 73245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactgcacaaaaaatatac

SEQ ID NO: 73246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatttttactgcacaaaaaa

SEQ ID NO: 73247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagatttttactgcacaaaa

SEQ ID NO: 73248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcagcacaaattctagatt

SEQ ID NO: 73249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgcagcacaaattctagat

SEQ ID NO: 73250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgccagacatacacaaaggc

SEQ ID NO: 73251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgatactgtgccagacat

SEQ ID NO: 73252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atccagtcacacactaaatg

SEQ ID NO: 73253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattcatccagtcacacact

SEQ ID NO: 73254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acattcatccagtcacacac

SEQ ID NO: 73255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaagtcaggacagaaactt

SEQ ID NO: 73256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaccaccataaaaagagga

SEQ ID NO: 73257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaaccaccataaaaagagg

SEQ ID NO: 73258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccttgtaaccaccataaaa

SEQ ID NO: 73259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtccttgtaaccaccata

SEQ ID NO: 73260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatattgttgtccttgtaa

SEQ ID NO: 73261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaaaatattgttgtccttg

SEQ ID NO: 73262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaaaattactaaaatatt

SEQ ID NO: 73263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttgaaaaaaattactaaa

SEQ ID NO: 73264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccactgagttgaaaaaaatt

SEQ ID NO: 73265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccactgagttgaaaaaaat

SEQ ID NO: 73266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttcccactgagttgaaaa

SEQ ID NO: 73267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacttcccactgagttgaaa

SEQ ID NO: 73268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcaggtatccagaaggtgg

SEQ ID NO: 73269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatcaggtatccagaaggt

SEQ ID NO: 73270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatcaaatctctcatcagg

SEQ ID NO: 73271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacatcaaatctctcatcag

SEQ ID NO: 73272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcagcttgacatcaaatct

SEQ ID NO: 73273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcacagttggtcagcttgac

SEQ ID NO: 73274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcacagttggtcagcttga

SEQ ID NO: 73275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acttgtcacagttggtcagc

SEQ ID NO: 73276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccacgttgacttgtcacagt

SEQ ID NO: 73277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatctgccacgttgacttg

SEQ ID NO: 73278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaatctgccacgttgact

SEQ ID NO: 73279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aattctcaaatctgccacgt

SEQ ID NO: 73280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctcaattctcaaatctgc

SEQ ID NO: 73281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgagccactcatctcaattc

SEQ ID NO: 73282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgagccactcatctcaat

SEQ ID NO: 73283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatgagccactcatctcaa

SEQ ID NO: 73284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctatgagccactcatctc

SEQ ID NO: 73285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggataaaatgctcttctatg

SEQ ID NO: 73286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagcaggagaaaattggga

SEQ ID NO: 73287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaagcaggagaaaattggg

SEQ ID NO: 73288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagcttacaagcaggagaaa

SEQ ID NO: 73289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagcttacaagcaggagaa

SEQ ID NO: 73290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaagcttacaagcaggaga

SEQ ID NO: 73291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgaaaactttcaagcttac

SEQ ID NO: 73292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attagtgaaaactttcaagc

SEQ ID NO: 73293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactgattagtgaaaacttt

SEQ ID NO: 73294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atactgattagtgaaaactt

SEQ ID NO: 73295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttatactgattagtgaaaa

SEQ ID NO: 73296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttatactgattagtgaaa

SEQ ID NO: 73297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccttatactgattagtga

SEQ ID NO: 73298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttccttatactgattagtg

SEQ ID NO: 73299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttccttatactgattagt

SEQ ID NO: 73300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttccttatactgattag

SEQ ID NO: 73301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttccttatactgatta

SEQ ID NO: 73302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcttccttatactgatt

SEQ ID NO: 73303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttcttccttatactgat

SEQ ID NO: 73304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttttcttccttatact

SEQ ID NO: 73305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttttcttccttatac

SEQ ID NO: 73306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttttcttccttata

SEQ ID NO: 73307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttttttcttccttat

SEQ ID NO: 73308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattttttttcttcctta

SEQ ID NO: 73309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttattttttttcttcctt

SEQ ID NO: 73310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttattttttttcttcct

SEQ ID NO: 73311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttattttttttcttcc

SEQ ID NO: 73312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttttattttttttcttc

SEQ ID NO: 73313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactttttttttattttttt

SEQ ID NO: 73314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtactttttttttatttttt

SEQ ID NO: 73315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcttgtactttttttttatt

SEQ ID NO: 73316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcttgtactttttttttat

SEQ ID NO: 73317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggcttgtacttttttttt

SEQ ID NO: 73318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttggcttgtactttttttt

SEQ ID NO: 73319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttggcttgtacttttttt

SEQ ID NO: 73320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgttttcttggcttgtact

SEQ ID NO: 73321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattagtgttttcttggctt

SEQ ID NO: 73322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattagtgttttcttggct

SEQ ID NO: 73323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaattagtgttttcttggc

SEQ ID NO: 73324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaattagtgttttcttgg

SEQ ID NO: 73325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgaattagtgttttcttg

SEQ ID NO: 73326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttttgaattagtgttttc

SEQ ID NO: 73327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctactttttgaattagtgt

SEQ ID NO: 73328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagcatcgcgtggacatagc

SEQ ID NO: 73329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcctatagcatcgcgtggac

SEQ ID NO: 73330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagccactggcctatagcat

SEQ ID NO: 73331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagccactggcctatagca

SEQ ID NO: 73332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccagccactggcctatagc

SEQ ID NO: 73333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgaaaaagttttccagccac

SEQ ID NO: 73334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgaaaaagttttccagcca

SEQ ID NO: 73335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacgaaaaagttttccagcc

SEQ ID NO: 73336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccctttacgaaaaagtttt

SEQ ID NO: 73337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggccctttacgaaaaagttt

SEQ ID NO: 73338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatttggccctttacgaaa

SEQ ID NO: 73339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcatttggccctttacgaa

SEQ ID NO: 73340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatatttatcatttggccc

SEQ ID NO: 73341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccatagaaatcgtatgccca

SEQ ID NO: 73342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagtggcagaggtgaatagc

SEQ ID NO: 73343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattacagtggcagaggtga

SEQ ID NO: 73344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattacagtggcagaggtg

SEQ ID NO: 73345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacattacagtggcagaggt

SEQ ID NO: 73346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttacattacagtggcagagg

SEQ ID NO: 73347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttttacattacagtggcag

SEQ ID NO: 73348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgactgcttttacattacag

SEQ ID NO: 73349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgactgcttttacattac

SEQ ID NO: 73350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatgactgcttttacatta

SEQ ID NO: 73351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgtatcttctatgactgctt

SEQ ID NO: 73352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgtatcttctatgactgct

SEQ ID NO: 73353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttacgtatcttctatgac

SEQ ID NO: 73354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaacataggaatgtcaattc

SEQ ID NO: 73355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaaacataggaatgtcaa

SEQ ID NO: 73356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcaaacataggaatgtca

SEQ ID NO: 73357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattcaaacataggaatgtc

SEQ ID NO: 73358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaactttattcaaacata

SEQ ID NO: 73359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgttcataaactttattca

SEQ ID NO: 73360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgttcataaactttattc

SEQ ID NO: 73361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgttcataaactttatt

SEQ ID NO: 73362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgaaatgcaaattttagt

SEQ ID NO: 73363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataatcaaaagaagaata

SEQ ID NO: 73364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtggttaaaataatcaaaa

SEQ ID NO: 73365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtggttaaaataatcaaa

SEQ ID NO: 73366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtggttaaaataatcaa

SEQ ID NO: 73367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagtggttaaaataatca

SEQ ID NO: 73368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttttaagtggttaaaat

SEQ ID NO: 73369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatttttaagtggttaaaa

SEQ ID NO: 73370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacatttttaagtggttaaa

SEQ ID NO: 73371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacatttttaagtggttaa

SEQ ID NO: 73372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaatgatttttacattttt

SEQ ID NO: 73373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggagctaagaatgattttta

SEQ ID NO: 73374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtggccctgggagctaaga

SEQ ID NO: 73375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtgtggccctgggagcta

SEQ ID NO: 73376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttattgtgtggccctgggag

SEQ ID NO: 73377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgccccacagaccaaagcca

SEQ ID NO: 73378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagcaaggatcagcacctat

SEQ ID NO: 73379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatagcaaggatcagcacct

SEQ ID NO: 73380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcctctatagcaaggatcag

SEQ ID NO: 73381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagccatgtgtaagactagc

SEQ ID NO: 73382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagccatgtgtaagactag

SEQ ID NO: 73383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcccgcaccttatagccat

SEQ ID NO: 73384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatggaccaaggcaaatg

SEQ ID NO: 73385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataataacaaaaatgaagtt

SEQ ID NO: 73386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttaataataacaaaaatg

SEQ ID NO: 73387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtaaataaaatataattaag

SEQ ID NO: 73388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactagtaaataaaatataa

SEQ ID NO: 73389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagctatactagtaaataaa

SEQ ID NO: 73390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagctatactagtaaataa

SEQ ID NO: 73391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgaagctatactagtaaat

SEQ ID NO: 73392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttgaagctatactagtaa

SEQ ID NO: 73393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagtgatggcatatgctct

SEQ ID NO: 73394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagtgatggcatatgctc

SEQ ID NO: 73395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaagtgatggcatatgct

SEQ ID NO: 73396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttgaaagtgatggcata

SEQ ID NO: 73397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taattttgaaagtgatggca

SEQ ID NO: 73398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaattttgaaagtgatgg

SEQ ID NO: 73399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctaattttgaaagtgatg

SEQ ID NO: 73400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctaattttgaaagtgat

SEQ ID NO: 73401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctctaattttgaaagtga

SEQ ID NO: 73402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctctaattttgaaagtg

SEQ ID NO: 73403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctttttctctaattttgaa

SEQ ID NO: 73404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatctttttctctaattttg

SEQ ID NO: 73405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatctttttctctaatttt

SEQ ID NO: 73406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggcaaaggtttctatcttt

SEQ ID NO: 73407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggcaaaggtttctatctt

SEQ ID NO: 73408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaggcaaaggtttctatct

SEQ ID NO: 73409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttaaggcaaaggtttct

SEQ ID NO: 73410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcattttaaggcaaaggtt

SEQ ID NO: 73411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctattcattttaaggcaaa

SEQ ID NO: 73412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatcactgcctattcatt

SEQ ID NO: 73413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaatcactgcctattcat

SEQ ID NO: 73414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaaatcactgcctattca

SEQ ID NO: 73415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaaaatcactgcctattc

SEQ ID NO: 73416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttttcaaaatcactgcc

SEQ ID NO: 73417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttttcaaaatcactgc

SEQ ID NO: 73418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gccaaataacccatatttat

SEQ ID NO: 73419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctagccaaataacccatatt

SEQ ID NO: 73420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctagccaaataacccatat

SEQ ID NO: 73421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctagccaaataacccata

SEQ ID NO: 73422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttttcctagccaaataacc

SEQ ID NO: 73423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattagttttcctagccaaa

SEQ ID NO: 73424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattagttttcctagccaa

SEQ ID NO: 73425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtattagttttcctagcca

SEQ ID NO: 73426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atacaagaaagaacaggaaa

SEQ ID NO: 73427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatacaagaaagaacaggaa

SEQ ID NO: 73428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatacaagaaagaacagga

SEQ ID NO: 73429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaaagaatagtgataattt

SEQ ID NO: 73430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgcaaaagaatagtgata

SEQ ID NO: 73431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaattgcaaaagaatagtg

SEQ ID NO: 73432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caattattaattgcaaaaga

SEQ ID NO: 73433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatctacaattattaattgc

SEQ ID NO: 73434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attatatctacaattattaa

SEQ ID NO: 73435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattaattatatctacaat

SEQ ID NO: 73436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataattaattatatctacaa

SEQ ID NO: 73437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataattaattatatctaca

SEQ ID NO: 73438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattttataattaattata

SEQ ID NO: 73439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataattttataattaattat

SEQ ID NO: 73440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataattttataattaatta

SEQ ID NO: 73441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttataattttataattaatt

SEQ ID NO: 73442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttataattttataatta

SEQ ID NO: 73443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatttttataattttataa

SEQ ID NO: 73444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatgatgtgatctattatt

SEQ ID NO: 73445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgatgatgtgatctattat

SEQ ID NO: 73446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgatgatgtgatctatta

SEQ ID NO: 73447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgtgatgatgtgatcta

SEQ ID NO: 73448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggaaattattttgtgatga

SEQ ID NO: 73449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtggaaattattttgtgat

SEQ ID NO: 73450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgtggaaattattttgtg

SEQ ID NO: 73451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctgtggaaattattttgt

SEQ ID NO: 73452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttctctgtggaaattatt

SEQ ID NO: 73453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttctctgtggaaattat

SEQ ID NO: 73454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatttctctgtggaaatta

SEQ ID NO: 73455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgcattttaatttctctgt

SEQ ID NO: 73456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtggtatgtaaccagatgtt

SEQ ID NO: 73457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaacctggtggtatgtaac

SEQ ID NO: 73458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgatggtcatggtcattg

SEQ ID NO: 73459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatgatggtcatggtcatt

SEQ ID NO: 73460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttacatgatggtcatggtc

SEQ ID NO: 73461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtttacatgatggtcatg

SEQ ID NO: 73462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgtttacatgatggtcat

SEQ ID NO: 73463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgccttattgtttacatg

SEQ ID NO: 73464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcaagctatgtgccttatt

SEQ ID NO: 73465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatggaggtcgctggtcaag

SEQ ID NO: 73466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtggagagtggatagagac

SEQ ID NO: 73467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgcgtgctgtgtggagagtg

SEQ ID NO: 73468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttccgcgtgctgtgtgga

SEQ ID NO: 73469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attgtgttccgcgtgctgtg

SEQ ID NO: 73470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgattgtgttccgcgtgct

SEQ ID NO: 73471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgattgtgttccgcgtgc

SEQ ID NO: 73472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttcctgattgtgttccgcg

SEQ ID NO: 73473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactccttcctgattgtgtt

SEQ ID NO: 73474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccactccttcctgattgtgt

SEQ ID NO: 73475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccactccttcctgattgt

SEQ ID NO: 73476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttccactccttcctgattg

SEQ ID NO: 73477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccacggtggcacatgaacga

SEQ ID NO: 73478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacgctcccacggtggcaca

SEQ ID NO: 73479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caagatcaatgatgactgta

SEQ ID NO: 73480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaagaatgtgtctgcaaga

SEQ ID NO: 73481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaagagctacaaagaatgt

SEQ ID NO: 73482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaagagctacaaagaatg

SEQ ID NO: 73483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtaagagctacaaagaat

SEQ ID NO: 73484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttggtaagagctacaaaga

SEQ ID NO: 73485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggtcggcatgcagctcttt

SEQ ID NO: 73486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtggtcggcatgcagctc

SEQ ID NO: 73487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgtggtcggcatgcagct

SEQ ID NO: 73488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctgtggtcggcatgcagc

SEQ ID NO: 73489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgctgtggtcggcatgcag

SEQ ID NO: 73490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttgctgtggtcggcat

SEQ ID NO: 73491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catttttgctgtggtcggca

SEQ ID NO: 73492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccatcatcgtcttcatttt

SEQ ID NO: 73493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgttggccatcatcgtctt

SEQ ID NO: 73494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtgttggccatcatcgtct

SEQ ID NO: 73495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accttagtgttggccatcat

SEQ ID NO: 73496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtaacctcaccttagtgtt

SEQ ID NO: 73497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taggtaacctcaccttagtg

SEQ ID NO: 73498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtaggggctctaggtaacc

SEQ ID NO: 73499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaactcagtaggggctcta

SEQ ID NO: 73500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agatcattggtaactcagta

SEQ ID NO: 73501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attaagatcattggtaactc

SEQ ID NO: 73502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacatgctgattaagatcat

SEQ ID NO: 73503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccaacattgaacatgctga

SEQ ID NO: 73504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaaaatcctggccaacatt

SEQ ID NO: 73505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagttggcaaaatcctggcc

SEQ ID NO: 73506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagttggcaaaatcctggc

SEQ ID NO: 73507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgagtcttcaagttggcaaa

SEQ ID NO: 73508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctccgagtcttcaagttgg

SEQ ID NO: 73509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctccgagtcttcaagttg

SEQ ID NO: 73510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagctccgagtcttcaagtt

SEQ ID NO: 73511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagctccgagtcttcaagt

SEQ ID NO: 73512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttagctccgagtcttca

SEQ ID NO: 73513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttttagctccgagtcttc

SEQ ID NO: 73514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttgcttttagctccgag

SEQ ID NO: 73515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttgcttttagctccga

SEQ ID NO: 73516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatatttgcttttagctccg

SEQ ID NO: 73517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactttatatttgcttttag

SEQ ID NO: 73518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acattaaactttatatttgc

SEQ ID NO: 73519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagtgattaacattaaact

SEQ ID NO: 73520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catagtgattaacattaaac

SEQ ID NO: 73521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatagtgattaacattaaa

SEQ ID NO: 73522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaagattttcatagtgatt

SEQ ID NO: 73523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaacattgaaaagattttc

SEQ ID NO: 73524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacaaaaatcaagattggaa

SEQ ID NO: 73525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaacaaaaatcaagattgga

SEQ ID NO: 73526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaacaaaaatcaagattgg

SEQ ID NO: 73527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctttgaacaaaaatcaag

SEQ ID NO: 73528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accctttgaacaaaaatcaa

SEQ ID NO: 73529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taccctttgaacaaaaatca

SEQ ID NO: 73530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttaccctttgaacaaaaa

SEQ ID NO: 73531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtctgctttaccctttga

SEQ ID NO: 73532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagtctgctttaccctttg

SEQ ID NO: 73533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggacttaaagtctgcttt

SEQ ID NO: 73534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gataataatgacaatattat

SEQ ID NO: 73535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctggataataatgacaata

SEQ ID NO: 73536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctggataataatgacaat

SEQ ID NO: 73537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagctggataataatgacaa

SEQ ID NO: 73538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgaaaatgaaaaataagaa

SEQ ID NO: 73539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaattgatgaaaatgaaaa

SEQ ID NO: 73540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggcaagtggaacaaaataa

SEQ ID NO: 73541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggcaagtggaacaaaata

SEQ ID NO: 73542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtggcaagtggaacaaaat

SEQ ID NO: 73543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtggcaagtggaacaaaa

SEQ ID NO: 73544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtggcaagtggaacaaa

SEQ ID NO: 73545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taattttttgtggcaagtgg

SEQ ID NO: 73546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataatatgtgttgtaatttt

SEQ ID NO: 73547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cataatatgtgttgtaattt

SEQ ID NO: 73548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcataatatgtgttgtaat

SEQ ID NO: 73549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcataatatgtgttgtaa

SEQ ID NO: 73550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagtacatagtttcttcat

SEQ ID NO: 73551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aactaaaagtacatagtttc

SEQ ID NO: 73552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagcaatcctgaactaaaag

SEQ ID NO: 73553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatagcaatcctgaactaaa

SEQ ID NO: 73554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatagcaatcctgaactaa

SEQ ID NO: 73555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgataagaggtttctatagc

SEQ ID NO: 73556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagaaaaatatcacaaatt

SEQ ID NO: 73557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaagaaaaatatcacaaa

SEQ ID NO: 73558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaattctaaaagaaaaata

SEQ ID NO: 73559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggataaattatcaattcta

SEQ ID NO: 73560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaagtagaattaaggataa

SEQ ID NO: 73561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtgtcggcatgagaaaatg

SEQ ID NO: 73562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctaagtgtcggcatgagaa

SEQ ID NO: 73563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctaagtgtcggcatgaga

SEQ ID NO: 73564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatctaagtgtcggcatgag

SEQ ID NO: 73565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gattttatctaagtgtcggc

SEQ ID NO: 73566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatgctagattttatctaa

SEQ ID NO: 73567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatatgctagattttatct

SEQ ID NO: 73568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctaatatgctagatttta

SEQ ID NO: 73569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagcacattcctctaatatg

SEQ ID NO: 73570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagcacattcctctaatat

SEQ ID NO: 73571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagcacattcctctaata

SEQ ID NO: 73572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaagcacattcctctaat

SEQ ID NO: 73573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaaagcacattcctctaa

SEQ ID NO: 73574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaatataaaaacaaataaa

SEQ ID NO: 73575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacaatataaaaacaaataa

SEQ ID NO: 73576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcttaacaatataaaaaca

SEQ ID NO: 73577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgatcttaacaatataaa

SEQ ID NO: 73578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtctgatcttaacaatat

SEQ ID NO: 73579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcccccaaaacaattgttgt

SEQ ID NO: 73580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatcccccaaaacaattgt

SEQ ID NO: 73581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagatcaaattgttatcccc

SEQ ID NO: 73582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaattaaagatcaaattgt

SEQ ID NO: 73583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaattaaagatcaaattg

SEQ ID NO: 73584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaatttggtaattaaagat

SEQ ID NO: 73585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaatttggtaattaaaga

SEQ ID NO: 73586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgaatttggtaattaaag

SEQ ID NO: 73587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataactttatgaatttggta

SEQ ID NO: 73588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgttcataactttatgaa

SEQ ID NO: 73589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgattatatgttcataac

SEQ ID NO: 73590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatgattatatgttcataa

SEQ ID NO: 73591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagaatttcaatgattatat

SEQ ID NO: 73592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acagaatttcaatgattata

SEQ ID NO: 73593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggcttacagaatttcaatg

SEQ ID NO: 73594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtggcttacagaatttcaat

SEQ ID NO: 73595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagtaagaagcttgtggct

SEQ ID NO: 73596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagagtaagaagcttgtggc

SEQ ID NO: 73597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcagagtaagaagcttgt

SEQ ID NO: 73598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcagagtaagaagcttg

SEQ ID NO: 73599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatagtacaataatttatt

SEQ ID NO: 73600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaatatagtacaataattt

SEQ ID NO: 73601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattaatatagtacaataat

SEQ ID NO: 73602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattaatatagtacaataa

SEQ ID NO: 73603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctattaatatagtacaata

SEQ ID NO: 73604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atataatataaatattttct

SEQ ID NO: 73605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtacacgctaatataata

SEQ ID NO: 73606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagtacacgctaatataat

SEQ ID NO: 73607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttgaagtacacgctaata

SEQ ID NO: 73608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatttgaagtacacgctaa

SEQ ID NO: 73609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aattctaatttgaagtacac

SEQ ID NO: 73610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagacatgctcaattctaat

SEQ ID NO: 73611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagacatgctcaattctaa

SEQ ID NO: 73612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagacatgctcaattcta

SEQ ID NO: 73613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaagacatgctcaattct

SEQ ID NO: 73614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatttttgaagacatgctc

SEQ ID NO: 73615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaatttttgaagacatgct

SEQ ID NO: 73616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaatttttgaagacatgc

SEQ ID NO: 73617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacaatttttgaagacatg

SEQ ID NO: 73618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaccacatgaatattttta

SEQ ID NO: 73619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaactaaaaccacatgaa

SEQ ID NO: 73620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagaactaaaaccacatga

SEQ ID NO: 73621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaaatgcacttaaagaact

SEQ ID NO: 73622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgacaaatgcacttaaag

SEQ ID NO: 73623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtaaaataaaatccattcat

SEQ ID NO: 73624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatctagtaaaataaaatc

SEQ ID NO: 73625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatatctagtaaaataaaat

SEQ ID NO: 73626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcttgatatctagtaaaa

SEQ ID NO: 73627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatcaaaaggcaagattata

SEQ ID NO: 73628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatcaaaaggcaagattat

SEQ ID NO: 73629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaatttgaatcaaaaggca

SEQ ID NO: 73630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaatttgaatcaaaaggc

SEQ ID NO: 73631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggaatttgaatcaaaagg

SEQ ID NO: 73632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgggaatttgaatcaaaag

SEQ ID NO: 73633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaacttttgggaatttgaa

SEQ ID NO: 73634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaacttttgggaatttga

SEQ ID NO: 73635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaacttttgggaatttg

SEQ ID NO: 73636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaacttttgggaattt

SEQ ID NO: 73637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttaaaaacttttgggaa

SEQ ID NO: 73638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattatttttaaaaactttt

SEQ ID NO: 73639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcattatttttaaaaacttt

SEQ ID NO: 73640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcattatttttaaaaactt

SEQ ID NO: 73641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttttgcattatttttaaaa

SEQ ID NO: 73642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttttgcattatttttaaa

SEQ ID NO: 73643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggttttgcattatttttaa

SEQ ID NO: 73644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttggttttgcattattttt

SEQ ID NO: 73645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttggttttgcattatttt

SEQ ID NO: 73646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taataaaggggtatttcttt

SEQ ID NO: 73647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataataaaggggtatttct

SEQ ID NO: 73648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattctataataaaggggta

SEQ ID NO: 73649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccattatattctataataaa

SEQ ID NO: 73650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggttgccattatattctat

SEQ ID NO: 73651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtaaacataaactaaggttg

SEQ ID NO: 73652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agactggtaaacataaacta

SEQ ID NO: 73653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgatcattcagactggtaaa

SEQ ID NO: 73654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcgatcattcagactggta

SEQ ID NO: 73655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagttctgcgatcattcag

SEQ ID NO: 73656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcagatgtggaaggattgtc

SEQ ID NO: 73657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagcagatgtggaaggattg

SEQ ID NO: 73658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagcagatgtggaaggatt

SEQ ID NO: 73659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctagcagatgtggaaggat

SEQ ID NO: 73660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttctagcagatgtggaagg

SEQ ID NO: 73661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtggagctctttctagcaga

SEQ ID NO: 73662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtggagctctttctagcag

SEQ ID NO: 73663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtttagtggagctctttct

SEQ ID NO: 73664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtttagtggagctctttc

SEQ ID NO: 73665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagtttagtggagctcttt

SEQ ID NO: 73666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgactttaagtttagtggag

SEQ ID NO: 73667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtgactttaagtttagtg

SEQ ID NO: 73668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgtgactttaagtttagt

SEQ ID NO: 73669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagccttattgtgacttta

SEQ ID NO: 73670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacagccttattgtgacttt

SEQ ID NO: 73671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacagccttattgtgactt

SEQ ID NO: 73672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgacagccttattgtgact

SEQ ID NO: 73673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatatttttgacagcctta

SEQ ID NO: 73674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagtaggctggaatatttt

SEQ ID NO: 73675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaagtaggctggaatattt

SEQ ID NO: 73676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatggatccatatgagtat

SEQ ID NO: 73677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attgccatggatccatatga

SEQ ID NO: 73678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaactgattgccatggatcc

SEQ ID NO: 73679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatggtattaaaactgatt

SEQ ID NO: 73680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagctgaaatggtattaaaa

SEQ ID NO: 73681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagctgaaatggtattaaa

SEQ ID NO: 73682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcagctgaaatggtattaa

SEQ ID NO: 73683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatctttgcagctgaaatg

SEQ ID NO: 73684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctggaatctttgcagctgaa

SEQ ID NO: 73685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actggaatctttgcagctga

SEQ ID NO: 73686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactggaatctttgcagctg

SEQ ID NO: 73687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtctttactggaatctttg

SEQ ID NO: 73688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggtctttactggaatcttt

SEQ ID NO: 73689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acttaggtctttactggaat

SEQ ID NO: 73690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcacttaggtctttactgga

SEQ ID NO: 73691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcacttaggtctttactgg

SEQ ID NO: 73692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcacttaggtctttactg

SEQ ID NO: 73693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcacttaggtctttact

SEQ ID NO: 73694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttctcacttaggtcttt

SEQ ID NO: 73695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagaaaaacattatttttc

SEQ ID NO: 73696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atattaacagaaaaacatta

SEQ ID NO: 73697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatattaacagaaaaacat

SEQ ID NO: 73698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaatattaacagaaaaaca

SEQ ID NO: 73699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaatattaacagaaaaac

SEQ ID NO: 73700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttctaatattaacagaaa

SEQ ID NO: 73701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgttttctaatattaacag

SEQ ID NO: 73702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgttttctaatattaaca

SEQ ID NO: 73703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttcctgttttctaatatt

SEQ ID NO: 73704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttgatttcctgttttcta

SEQ ID NO: 73705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcattgtgttgatttcctgt

SEQ ID NO: 73706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatcattgtgttgatttcc

SEQ ID NO: 73707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcaaacagtgattattatc

SEQ ID NO: 73708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaacacagtaaatgctaagc

SEQ ID NO: 73709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctggaacacagtaaatgct

SEQ ID NO: 73710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaaactgtctggaacacag

SEQ ID NO: 73711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcaaactgtctggaacaca

SEQ ID NO: 73712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagtatttagcaaactgt

SEQ ID NO: 73713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaagtatttagcaaactg

SEQ ID NO: 73714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataagaatatccatttata

SEQ ID NO: 73715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agttagataagaatatccat

SEQ ID NO: 73716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggactaagttagataaga

SEQ ID NO: 73717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaggactaagttagataag

SEQ ID NO: 73718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttacaggactaagttaga

SEQ ID NO: 73719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatgggagccagggaagag

SEQ ID NO: 73720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgctgatatgggagccagg

SEQ ID NO: 73721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgctgatatgggagccag

SEQ ID NO: 73722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatgctgatatgggagcca

SEQ ID NO: 73723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgatgctgatatgggagcc

SEQ ID NO: 73724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaccttttgatgctgatatg

SEQ ID NO: 73725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaccttttgatgctgatat

SEQ ID NO: 73726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaccttttgatgctgata

SEQ ID NO: 73727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcaaccttttgatgctgat

SEQ ID NO: 73728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagcttttcaaccttttgat

SEQ ID NO: 73729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acaggacagttagagctttt

SEQ ID NO: 73730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatgatgagcactgacag

SEQ ID NO: 73731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctaaaaatgatgagcactg

SEQ ID NO: 73732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatgctgtctaaaaatgat

SEQ ID NO: 73733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaatgctgtctaaaaatg

SEQ ID NO: 73734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctaaaatgctgtctaaaa

SEQ ID NO: 73735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatgctattctaaaatgct

SEQ ID NO: 73736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatatgctattctaaaatgc

SEQ ID NO: 73737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatatgctattctaaaatg

SEQ ID NO: 73738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaattttaatatgctattct

SEQ ID NO: 73739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaattttaatatgctatt

SEQ ID NO: 73740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgaaattttaatatgctat

SEQ ID NO: 73741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctgaaattttaatatgct

SEQ ID NO: 73742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcttctgaaattttaatat

SEQ ID NO: 73743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcttctgaaattttaata

SEQ ID NO: 73744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactcttctgaaattttaat

SEQ ID NO: 73745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaaatgttttactcttctg

SEQ ID NO: 73746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtcaattaccaaatgtttt

SEQ ID NO: 73747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaatagtgactgtgtcaat

SEQ ID NO: 73748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaatagtgactgtgtcaa

SEQ ID NO: 73749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaaaatagtgactgtgtca

SEQ ID NO: 73750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgaaaatagtgactgtgt

SEQ ID NO: 73751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acccacataaattctttgaa

SEQ ID NO: 73752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacccacataaattctttga

SEQ ID NO: 73753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacccacataaattctttg

SEQ ID NO: 73754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgacccacataaattcttt

SEQ ID NO: 73755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgacccacataaattctt

SEQ ID NO: 73756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagaacaactttttgaccca

SEQ ID NO: 73757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccagaacaactttttgaccc

SEQ ID NO: 73758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccagaacaactttttgac

SEQ ID NO: 73759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttccagaacaactttttga

SEQ ID NO: 73760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttcttccagaacaacttt

SEQ ID NO: 73761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcttcttccagaacaactt

SEQ ID NO: 73762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcttcttccagaacaact

SEQ ID NO: 73763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatcttcttccagaacaac

SEQ ID NO: 73764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttatcttcttccagaacaa

SEQ ID NO: 73765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttatcttcttccagaac

SEQ ID NO: 73766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttatcttcttccagaa

SEQ ID NO: 73767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttttatcttcttccaga

SEQ ID NO: 73768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttttctttttatcttctt

SEQ ID NO: 73769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgttttctttttatcttct

SEQ ID NO: 73770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtatcaacttatgttttct

SEQ ID NO: 73771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtatcaacttatgttttc

SEQ ID NO: 73772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaatttcagtatcaactta

SEQ ID NO: 73773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctcaaaatttcagtatcaa

SEQ ID NO: 73774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acagtagtcagatcagaaaa

SEQ ID NO: 73775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taacagtagtcagatcagaa

SEQ ID NO: 73776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctaacagtagtcagatca

SEQ ID NO: 73777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactctaacagtagtcaga

SEQ ID NO: 73778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attactctaacagtagtcag

SEQ ID NO: 73779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattactctaacagtagtca

SEQ ID NO: 73780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttattactctaacagtagt

SEQ ID NO: 73781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagagtgagtcaacatgttc

SEQ ID NO: 73782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagagtgagtcaacatgtt

SEQ ID NO: 73783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaagagtgagtcaacatgt

SEQ ID NO: 73784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataaatctttaaagagtgag

SEQ ID NO: 73785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgataaatctttaaagagt

SEQ ID NO: 73786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgctgataaatctttaaaga

SEQ ID NO: 73787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgctgataaatctttaaag

SEQ ID NO: 73788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctgctgataaatctttaa

SEQ ID NO: 73789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttctgctgataaatcttt

SEQ ID NO: 73790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttctgctgataaatctt

SEQ ID NO: 73791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcttctgctgataaatct

SEQ ID NO: 73792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcttctgctgataaatc

SEQ ID NO: 73793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctcttctgctgataaat

SEQ ID NO: 73794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttctcttctgctgataaa

SEQ ID NO: 73795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatacttttttctcttctgc

SEQ ID NO: 73796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaattaaatacttttttct

SEQ ID NO: 73797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccacattgtcaattaaatac

SEQ ID NO: 73798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctgccacattgtcaattaa

SEQ ID NO: 73799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctgccacattgtcaatta

SEQ ID NO: 73800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagctgccacattgtcaatt

SEQ ID NO: 73801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttagctgccacattgtca

SEQ ID NO: 73802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagtattactttagctgcc

SEQ ID NO: 73803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaagtattactttagctgc

SEQ ID NO: 73804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagaagtattactttagctg

SEQ ID NO: 73805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtcaaagctttagaagtat

SEQ ID NO: 73806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtcaaagctttagaagta

SEQ ID NO: 73807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtcaaagctttagaagt

SEQ ID NO: 73808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtgtcaaagctttagaag

SEQ ID NO: 73809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatgcacttttgtgtcaaa

SEQ ID NO: 73810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaatgcacttttgtgtcaa

SEQ ID NO: 73811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcaatgcacttttgtgtca

SEQ ID NO: 73812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgatattttgcaatgcact

SEQ ID NO: 73813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataccagtatcatgaattaa

SEQ ID NO: 73814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gataccagtatcatgaatta

SEQ ID NO: 73815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgataccagtatcatgaatt

SEQ ID NO: 73816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgagtcctttgataccag

SEQ ID NO: 73817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtgagtcctttgatacca

SEQ ID NO: 73818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtgagtcctttgatacc

SEQ ID NO: 73819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagtgagtcctttgatac

SEQ ID NO: 73820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaagtgagtcctttgata

SEQ ID NO: 73821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctttttaagtgagtccttt

SEQ ID NO: 73822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggtgttgcctttttaagtga

SEQ ID NO: 73823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cggtgttgcctttttaagtg

SEQ ID NO: 73824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttcggtgttgccttttta

SEQ ID NO: 73825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtcaaagtgtacccaaagg

SEQ ID NO: 73826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtcaaagtgtacccaaag

SEQ ID NO: 73827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgagtcaaagtgtaccca

SEQ ID NO: 73828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcagattccttgagtcaaa

SEQ ID NO: 73829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtcagattccttgagtcaa

SEQ ID NO: 73830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtcagattccttgagtca

SEQ ID NO: 73831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttggtcagattccttgagt

SEQ ID NO: 73832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttggtcagattccttgag

SEQ ID NO: 73833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatcttctttggtcagatt

SEQ ID NO: 73834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaatcttctttggtcagat

SEQ ID NO: 73835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttagaatcttctttggtc

SEQ ID NO: 73836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccttagaatcttctttggt

SEQ ID NO: 73837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacatttcccttagaatctt

SEQ ID NO: 73838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagacctaaacatttccctt

SEQ ID NO: 73839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagttatagacctaaacatt

SEQ ID NO: 73840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcagttatagacctaaac

SEQ ID NO: 73841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actcctgcagttatagacct

SEQ ID NO: 73842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaattgactcctgcagtta

SEQ ID NO: 73843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaattgactcctgcagtt

SEQ ID NO: 73844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgaaaattgactcctgca

SEQ ID NO: 73845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattatttgaaaattgactc

SEQ ID NO: 73846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcctgcattatttgaaaat

SEQ ID NO: 73847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatcctgcattatttgaaaa

SEQ ID NO: 73848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgatcctgcattatttgaa

SEQ ID NO: 73849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgatcctgcattatttga

SEQ ID NO: 73850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaatcttcttgatcctgca

SEQ ID NO: 73851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctgccaatcttcttgatcc

SEQ ID NO: 73852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctccctgccaatcttcttga

SEQ ID NO: 73853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagtccagctgctccctgcc

SEQ ID NO: 73854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccacaacctcaagtccagct

SEQ ID NO: 73855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaccacaacctcaagtcca

SEQ ID NO: 73856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcacagctattaccacaac

SEQ ID NO: 73857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctggtcacagctattacca

SEQ ID NO: 73858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctggtcacagctattacc

SEQ ID NO: 73859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaaaggatttacctggtca

SEQ ID NO: 73860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaactcagaaaggatttac

SEQ ID NO: 73861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catccctgtgaactcagaaa

SEQ ID NO: 73862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agacgactgcatccctgtga

SEQ ID NO: 73863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgagacgactgcatccct

SEQ ID NO: 73864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcactgagacgactgcatcc

SEQ ID NO: 73865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcactgagacgactgcatc

SEQ ID NO: 73866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaataagtaccttctcact

SEQ ID NO: 73867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcaaataagtaccttctcac

SEQ ID NO: 73868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtggagatccggatcttgca

SEQ ID NO: 73869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttggtggagatccggatctt

SEQ ID NO: 73870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attgttggtggagatccgga

SEQ ID NO: 73871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taattgttggtggagatccg

SEQ ID NO: 73872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaattgttggtggagatcc

SEQ ID NO: 73873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttctaattgttggtggag

SEQ ID NO: 73874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaaaggcaggaatatcta

SEQ ID NO: 73875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaaaaggcaggaatatct

SEQ ID NO: 73876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggaaaaaggcaggaatatc

SEQ ID NO: 73877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttggaaaaaggcaggaa

SEQ ID NO: 73878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctttggaaaaaggcagga

SEQ ID NO: 73879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttatctttggaaaaaggca

SEQ ID NO: 73880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatttatctttggaaaaagg

SEQ ID NO: 73881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatttatctttggaaaaag

SEQ ID NO: 73882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttctatttatctttggaa

SEQ ID NO: 73883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccttctatttatctttgga

SEQ ID NO: 73884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcccttctatttatctttg

SEQ ID NO: 73885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttcccttctatttatcttt

SEQ ID NO: 73886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttcccttctatttatct

SEQ ID NO: 73887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcattcttcttcccttctat

SEQ ID NO: 73888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttagcattcttcttccct

SEQ ID NO: 73889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gctgagttagcattcttctt

SEQ ID NO: 73890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccatgtgctcgctgagtta

SEQ ID NO: 73891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccatgtgctcgctgagtt

SEQ ID NO: 73892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccccatgtgctcgctgagt

SEQ ID NO: 73893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccccatgtgctcgctgag

SEQ ID NO: 73894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaatgtttttccccatgtg

SEQ ID NO: 73895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaatattcccaatgttttt

SEQ ID NO: 73896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctacaaatattcccaatgt

SEQ ID NO: 73897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattgtctacaaatattccc

SEQ ID NO: 73898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaattgtctacaaatattc

SEQ ID NO: 73899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaaattgtctacaaatatt

SEQ ID NO: 73900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctaaattgtctacaaata

SEQ ID NO: 73901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctaaattgtctacaaat

SEQ ID NO: 73902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttctaaattgtctacaaa

SEQ ID NO: 73903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttctaaattgtctacaa

SEQ ID NO: 73904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttttcttctaaattgtct

SEQ ID NO: 73905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtctgtcttttcttctaaa

SEQ ID NO: 73906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagtctgtcttttcttcta

SEQ ID NO: 73907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgagtctgtcttttcttct

SEQ ID NO: 73908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgagtctgtcttttcttc

SEQ ID NO: 73909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctgagtctgtcttttctt

SEQ ID NO: 73910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttctgagtctgtcttttc

SEQ ID NO: 73911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaccagaagttcttttct

SEQ ID NO: 73912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagaccagaagttcttttc

SEQ ID NO: 73913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatttgaagaccagaagtt

SEQ ID NO: 73914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggtcccaaacaaattgaca

SEQ ID NO: 73915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtggtcccaaacaaattg

SEQ ID NO: 73916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgtggtcccaaacaaatt

SEQ ID NO: 73917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctgtggtcccaaacaaat

SEQ ID NO: 73918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgctgtggtcccaaacaaa

SEQ ID NO: 73919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttgctgtggtcccaaac

SEQ ID NO: 73920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttttgctgtggtcccaaa

SEQ ID NO: 73921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcttttgctgtggtcccaa

SEQ ID NO: 73922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataagataattttgctttt

SEQ ID NO: 73923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaatgtctatataagataa

SEQ ID NO: 73924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcaatgtctatataagata

SEQ ID NO: 73925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtcaatgtctatataagat

SEQ ID NO: 73926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtatctttgtcaatgtcta

SEQ ID NO: 73927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtatctttgtcaatgtct

SEQ ID NO: 73928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggtatctttgtcaatgtc

SEQ ID NO: 73929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaaccatgaataactttg

SEQ ID NO: 73930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cataaaccatgaataacttt

SEQ ID NO: 73931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcataaaccatgaataact

SEQ ID NO: 73932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgactcttcataaaccatga

SEQ ID NO: 73933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgactcttcataaaccatg

SEQ ID NO: 73934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcttatgactcttcataaa

SEQ ID NO: 73935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggccagagaatctcagctt

SEQ ID NO: 73936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggccagagaatctcagct

SEQ ID NO: 73937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagggccagagaatctcagc

SEQ ID NO: 73938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagggccagagaatctcag

SEQ ID NO: 73939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttagggccagagaatc

SEQ ID NO: 73940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggatgtgaggcaggcacca

SEQ ID NO: 73941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actatggatgtgaggcaggc

SEQ ID NO: 73942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactatggatgtgaggcagg

SEQ ID NO: 73943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgactatggatgtgaggcag

SEQ ID NO: 73944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgactatggatgtgaggca

SEQ ID NO: 73945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agggtaaacaaaatgccagt

SEQ ID NO: 73946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actcagggtaaacaaaatgc

SEQ ID NO: 73947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcacactaactcagggtaa

SEQ ID NO: 73948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatgtacagtgctggtcac

SEQ ID NO: 73949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaaatgtacagtgctggtc

SEQ ID NO: 73950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgccagagtgatctctaaa

SEQ ID NO: 73951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaaattgatgccagagtg

SEQ ID NO: 73952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagatataagatccaatta

SEQ ID NO: 73953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaagatataagatccaat

SEQ ID NO: 73954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggaagatataagatccaa

SEQ ID NO: 73955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaggataggcaagaaggtga

SEQ ID NO: 73956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacatagaagactcaaggat

SEQ ID NO: 73957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactggacatagaagactca

SEQ ID NO: 73958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaaccaaaatggttgaac

SEQ ID NO: 73959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaaaccaaaatggttgaa

SEQ ID NO: 73960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagaaaccaaaatggttga

SEQ ID NO: 73961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttgagaaaccaaaatggt

SEQ ID NO: 73962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaacaactattttgagaaa

SEQ ID NO: 73963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaacaactattttgagaa

SEQ ID NO: 73964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaaacaactattttgaga

SEQ ID NO: 73965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaaacaagctttaaaaac

SEQ ID NO: 73966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatgaaacaagctttaaaaa

SEQ ID NO: 73967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagacttaatgaaacaagc

SEQ ID NO: 73968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaagacttaatgaaacaag

SEQ ID NO: 73969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatcaaaacttcaaagact

SEQ ID NO: 73970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcatcatcatcaacatcatt

SEQ ID NO: 73971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagctatcatcatcatcaac

SEQ ID NO: 73972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcatatagtaaatacacaat

SEQ ID NO: 73973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcctggcatatagtaaatac

SEQ ID NO: 73974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagcctggcatatagtaaa

SEQ ID NO: 73975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attagcctggcatatagtaa

SEQ ID NO: 73976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttattagcctggcatatag

SEQ ID NO: 73977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcttattagcctggcatat

SEQ ID NO: 73978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcttattagcctggcata

SEQ ID NO: 73979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgcttattagcctggcat

SEQ ID NO: 73980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgctttctgcttattagc

SEQ ID NO: 73981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggattaaatgctttctg

SEQ ID NO: 73982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggaggattaaatgctttct

SEQ ID NO: 73983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgggaggattaaatgcttt

SEQ ID NO: 73984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatattcttgggaggatta

SEQ ID NO: 73985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcatattcttgggaggatt

SEQ ID NO: 73986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttatcatattcttgggag

SEQ ID NO: 73987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttatcatattcttggga

SEQ ID NO: 73988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatttcatttatcatattct

SEQ ID NO: 73989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taactgtatttcatttatca

SEQ ID NO: 73990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatataattgtaactgtat

SEQ ID NO: 73991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatataattgtaactgta

SEQ ID NO: 73992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttataatataattgtaact

SEQ ID NO: 73993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaataattatttataata

SEQ ID NO: 73994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attataaaataattatttat

SEQ ID NO: 73995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattataaaataattattta

SEQ ID NO: 73996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaataatacttcattata

SEQ ID NO: 73997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaaataatacttcattat

SEQ ID NO: 73998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatttataaaataatactt

SEQ ID NO: 73999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcatttataaaataatact

SEQ ID NO: 74000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcatttataaaataatac

SEQ ID NO: 74001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttatcatttataaaata

SEQ ID NO: 74002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttatcatttataaaat

SEQ ID NO: 74003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagtatttaattttatcatt

SEQ ID NO: 74004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtagtatttaattttatca

SEQ ID NO: 74005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actctgtagtatttaatttt

SEQ ID NO: 74006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactctgtagtatttaattt

SEQ ID NO: 74007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taactctgtagtatttaatt

SEQ ID NO: 74008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacaaatattttaactctgt

SEQ ID NO: 74009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggacaaatattttaactctg

SEQ ID NO: 74010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgagtgatatgcccttgg

SEQ ID NO: 74011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattatatgagtgatatgcc

SEQ ID NO: 74012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcattatatgagtgatatg

SEQ ID NO: 74013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attctgcattatatgagtga

SEQ ID NO: 74014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgctgattctgcattata

SEQ ID NO: 74015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatgctgattctgcattat

SEQ ID NO: 74016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtttgaatgctgattctgc

SEQ ID NO: 74017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagtcccaaagtcctgggt

SEQ ID NO: 74018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtcctcagagtcccaaagt

SEQ ID NO: 74019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtcctcagagtcccaaag

SEQ ID NO: 74020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acataatagtagtgaagtgt

SEQ ID NO: 74021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacataatagtagtgaagtg

SEQ ID NO: 74022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgacataatagtagtgaagt

SEQ ID NO: 74023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttgacataatagtagtga

SEQ ID NO: 74024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggatgtattgctttgacat

SEQ ID NO: 74025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaaacctatggatgtatt

SEQ ID NO: 74026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaaaacctatggatgtat

SEQ ID NO: 74027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagaaaacctatggatgta

SEQ ID NO: 74028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acatattttcagaaaaccta

SEQ ID NO: 74029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagtacacacctcacatat

SEQ ID NO: 74030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaagtacacacctcacata

SEQ ID NO: 74031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtaagtacacacctcaca

SEQ ID NO: 74032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgtaagtacacacctcac

SEQ ID NO: 74033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttgtaagtacacacctca

SEQ ID NO: 74034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttcttgtaagtacacacc

SEQ ID NO: 74035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgctttcttgtaagtacac

SEQ ID NO: 74036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattgctgctttcttgtaag

SEQ ID NO: 74037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attacattgctgctttcttg

SEQ ID NO: 74038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaattacattgctgctttc

SEQ ID NO: 74039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctaattacattgctgcttt

SEQ ID NO: 74040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaccttcctaattacattg

SEQ ID NO: 74041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcacaccttcctaattacat

SEQ ID NO: 74042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcacaccttcctaattaca

SEQ ID NO: 74043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcacaccttcctaattac

SEQ ID NO: 74044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctcacaccttcctaatt

SEQ ID NO: 74045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttctttctcacaccttcct

SEQ ID NO: 74046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttctttctcacaccttcc

SEQ ID NO: 74047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggttctttctcacaccttc

SEQ ID NO: 74048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggttctttctcacacctt

SEQ ID NO: 74049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatttttggttctttctca

SEQ ID NO: 74050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacatttttggttctttctc

SEQ ID NO: 74051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggagcaacacttaacatttt

SEQ ID NO: 74052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggagcaacacttaacattt

SEQ ID NO: 74053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgggagcaacacttaacat

SEQ ID NO: 74054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgggagcaacacttaaca

SEQ ID NO: 74055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccagcatatttcttgggagc

SEQ ID NO: 74056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgccagcatatttcttggga

SEQ ID NO: 74057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgccagcatatttcttggg

SEQ ID NO: 74058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgccagcatatttcttgg

SEQ ID NO: 74059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgccagcatatttcttg

SEQ ID NO: 74060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctgccagcatatttctt

SEQ ID NO: 74061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataatgattttttctgccag

SEQ ID NO: 74062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggagttgataatgatttttt

SEQ ID NO: 74063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggagttgataatgattttt

SEQ ID NO: 74064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatcttgggagttgataat

SEQ ID NO: 74065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaaggttaccatcttggg

SEQ ID NO: 74066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataaaaggttaccatcttg

SEQ ID NO: 74067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctataaaaggttaccatctt

SEQ ID NO: 74068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctataaaaggttaccat

SEQ ID NO: 74069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaataacaatactatttct

SEQ ID NO: 74070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggtctacaaataacaatac

SEQ ID NO: 74071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgaggtctacaaataacaa

SEQ ID NO: 74072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcagtactgttgaggtcta

SEQ ID NO: 74073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataattgtgcagtactgt

SEQ ID NO: 74074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaataattgtgcagtactg

SEQ ID NO: 74075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaataattgtgcagtact

SEQ ID NO: 74076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaataattgtgcagtac

SEQ ID NO: 74077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtcttttaaaataattgtg

SEQ ID NO: 74078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttatgtcttttaaaataat

SEQ ID NO: 74079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggttatgtcttttaaaata

SEQ ID NO: 74080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggttatgtcttttaaaat

SEQ ID NO: 74081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catatgaatggatgtgtaga

SEQ ID NO: 74082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatatgaatggatgtgtag

SEQ ID NO: 74083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccatatgaatggatgtgta

SEQ ID NO: 74084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcatatccagaactttcca

SEQ ID NO: 74085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaattatgcatatccagaa

SEQ ID NO: 74086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagcctcagaattatgcata

SEQ ID NO: 74087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtcagatgaatctgcagcc

SEQ ID NO: 74088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtcagatgaatctgcagc

SEQ ID NO: 74089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtcagatgaatctgcag

SEQ ID NO: 74090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatgtcagatgaatctgca

SEQ ID NO: 74091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatgtcagatgaatctgc

SEQ ID NO: 74092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atattttttatgtcagatga

SEQ ID NO: 74093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catattttttatgtcagatg

SEQ ID NO: 74094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatttcatattttttatgt

SEQ ID NO: 74095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatcattgtcatttcatat

SEQ ID NO: 74096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttgtcatcattgtcatttc

SEQ ID NO: 74097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttgtcatcattgtcattt

SEQ ID NO: 74098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagttgtcatcattgtcatt

SEQ ID NO: 74099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagttgtcatcattgtcat

SEQ ID NO: 74100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttagttgtcatcattgtca

SEQ ID NO: 74101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttttagttgtcatcattgt

SEQ ID NO: 74102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttttagttgtcatcatt

SEQ ID NO: 74103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctttttagttgtcatcat

SEQ ID NO: 74104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atagtttctctttttagttg

SEQ ID NO: 74105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtactcatagtttctcttt

SEQ ID NO: 74106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgttatgtactcatagtt

SEQ ID NO: 74107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtgtgttatgtactcata

SEQ ID NO: 74108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgtgtgttatgtactcat

SEQ ID NO: 74109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttattgtgtgttatgtactc

SEQ ID NO: 74110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaagtctcttattgtgtgt

SEQ ID NO: 74111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaagtctcttattgtgtg

SEQ ID NO: 74112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggaaatttggtaagtctc

SEQ ID NO: 74113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctataggaaatttggtaagt

SEQ ID NO: 74114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctataggaaatttggtaag

SEQ ID NO: 74115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaatgtacttgctatagg

SEQ ID NO: 74116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggaattcaaaaatgtactt

SEQ ID NO: 74117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggaacaccacccaatgact

SEQ ID NO: 74118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggctatggaacaccaccca

SEQ ID NO: 74119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggctatggaacaccaccc

SEQ ID NO: 74120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatggctatggaacacca

SEQ ID NO: 74121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacacattatttatggctat

SEQ ID NO: 74122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacacattatttatggcta

SEQ ID NO: 74123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaacacattatttatggct

SEQ ID NO: 74124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catagttttaaacacattat

SEQ ID NO: 74125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatagttttaaacacatta

SEQ ID NO: 74126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatttgcatagttttaaac

SEQ ID NO: 74127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caattaccatttgcatagtt

SEQ ID NO: 74128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcaattaccatttgcatagt

SEQ ID NO: 74129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagatcttgcaattaccatt

SEQ ID NO: 74130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagatcttgcaattaccat

SEQ ID NO: 74131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtagatcttgcaattacca

SEQ ID NO: 74132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtagatcttgcaattacc

SEQ ID NO: 74133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatggatccttttgtagat

SEQ ID NO: 74134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtaatggatccttttgta

SEQ ID NO: 74135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgtaatggatccttttgt

SEQ ID NO: 74136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgtaatggatccttttg

SEQ ID NO: 74137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttattgtaatggatcctt

SEQ ID NO: 74138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaagtgtatctattttat

SEQ ID NO: 74139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gataaaattcaaaaagtgta

SEQ ID NO: 74140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catattggataaaattcaaa

SEQ ID NO: 74141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccatattggataaaattca

SEQ ID NO: 74142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctccatattggataaaat

SEQ ID NO: 74143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaattgctctccatattgga

SEQ ID NO: 74144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atctggaattgctctccata

SEQ ID NO: 74145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatctggaattgctctccat

SEQ ID NO: 74146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgatctggaattgctctcc

SEQ ID NO: 74147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacacaaattcttgatctgg

SEQ ID NO: 74148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacacaaattcttgatctg

SEQ ID NO: 74149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtggtacagatttgcacaca

SEQ ID NO: 74150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtggtacagatttgcacac

SEQ ID NO: 74151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagagtccagacaaaaatgt

SEQ ID NO: 74152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagagtccagacaaaaatg

SEQ ID NO: 74153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccagaacttgaagagtccag

SEQ ID NO: 74154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccagaacttgaagagtcc

SEQ ID NO: 74155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcccagaacttgaagagtc

SEQ ID NO: 74156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcccagaacttgaagagt

SEQ ID NO: 74157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcccagaacttgaagag

SEQ ID NO: 74158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctcccagaacttgaaga

SEQ ID NO: 74159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttctcccagaacttgaag

SEQ ID NO: 74160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttttttctcccagaacttg

SEQ ID NO: 74161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcttttttctcccagaact

SEQ ID NO: 74162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgcttttttctcccagaa

SEQ ID NO: 74163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgttctctgcttttttct

SEQ ID NO: 74164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actccatgttctctgctttt

SEQ ID NO: 74165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagtgaaacagacaaatgg

SEQ ID NO: 74166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttaggagtgaaacagacaa

SEQ ID NO: 74167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatctggttaggagtgaaac

SEQ ID NO: 74168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatctggttaggagtgaaa

SEQ ID NO: 74169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttgtatctggttaggagt

SEQ ID NO: 74170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actgatttgtatctggttag

SEQ ID NO: 74171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatgcctgactgatttgta

SEQ ID NO: 74172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatattagaatgcctgactg

SEQ ID NO: 74173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatattagaatgcctgact

SEQ ID NO: 74174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcaatattagaatgcctg

SEQ ID NO: 74175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttcaatattagaatgcct

SEQ ID NO: 74176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaccttgtttcaatatta

SEQ ID NO: 74177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactataaaccttgtttcaa

SEQ ID NO: 74178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatctaaactataaacct

SEQ ID NO: 74179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaatctaaactataaacc

SEQ ID NO: 74180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaaatctaaactataaac

SEQ ID NO: 74181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattttcaaaatctaaacta

SEQ ID NO: 74182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaaattttcaaaatctaaa

SEQ ID NO: 74183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatagtactgttaaatttt

SEQ ID NO: 74184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgaaatagtactgttaaa

SEQ ID NO: 74185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgaaatagtactgttaa

SEQ ID NO: 74186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcattgaaatagtactgtta

SEQ ID NO: 74187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgctttcattgaaatagtac

SEQ ID NO: 74188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataagaggctatgctttca

SEQ ID NO: 74189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acataagaggctatgctttc

SEQ ID NO: 74190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcaacgaacatgtcataat

SEQ ID NO: 74191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctaggcaacgaacatgtc

SEQ ID NO: 74192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catctaggcaacgaacatgt

SEQ ID NO: 74193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcttcatctaggcaacgaa

SEQ ID NO: 74194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgcttcatctaggcaacga

SEQ ID NO: 74195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttatgcttcatctaggcaac

SEQ ID NO: 74196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttatgcttcatctaggca

SEQ ID NO: 74197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctctcttatgcttcatct

SEQ ID NO: 74198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accctctcttatgcttcatc

SEQ ID NO: 74199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttaccctctcttatgcttc

SEQ ID NO: 74200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttaccctctcttatgctt

SEQ ID NO: 74201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttccttaccctctcttat

SEQ ID NO: 74202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacttccttaccctctctta

SEQ ID NO: 74203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtcataaatttcacttcc

SEQ ID NO: 74204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcagtcataaatttcacttc

SEQ ID NO: 74205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagatgcccacatatgtgc

SEQ ID NO: 74206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaaagatgcccacatatgt

SEQ ID NO: 74207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgaaagatgcccacatat

SEQ ID NO: 74208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctgaaagatgcccacata

SEQ ID NO: 74209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctgaaagatgcccacat

SEQ ID NO: 74210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctctgaaagatgcccaca

SEQ ID NO: 74211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtgcatttttctctgaaag

SEQ ID NO: 74212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatcacatgttaggtgcat

SEQ ID NO: 74213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accatcacatgttaggtgca

SEQ ID NO: 74214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttaccatcacatgttaggt

SEQ ID NO: 74215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgtttaccatcacatgtta

SEQ ID NO: 74216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctgtttaccatcacatgt

SEQ ID NO: 74217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggaaacatagttctcctgt

SEQ ID NO: 74218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaaggaaacatagttctcc

SEQ ID NO: 74219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttaaggaaacatagttct

SEQ ID NO: 74220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgttaaggaaacatagtt

SEQ ID NO: 74221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctgttaaggaaacatagt

SEQ ID NO: 74222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtggaaaacatacatttctc

SEQ ID NO: 74223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaacacaggtgaaaaatat

SEQ ID NO: 74224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatgggactaaaaacacag

SEQ ID NO: 74225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtcatgggactaaaaaca

SEQ ID NO: 74226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgttgtcatgggactaaaa

SEQ ID NO: 74227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgttgtcatgggactaaa

SEQ ID NO: 74228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcttattgttgtcatggga

SEQ ID NO: 74229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacagaatagtctcatctta

SEQ ID NO: 74230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggacagaatagtctcatct

SEQ ID NO: 74231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggacagaatagtctcatc

SEQ ID NO: 74232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctggacagaatagtctcat

SEQ ID NO: 74233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctggacagaatagtctca

SEQ ID NO: 74234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctggacagaatagtctc

SEQ ID NO: 74235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagcaagagttttttctgga

SEQ ID NO: 74236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttacagcaagagttttttct

SEQ ID NO: 74237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaactattacagcaagagt

SEQ ID NO: 74238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctgtgaactattacagca

SEQ ID NO: 74239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacctgtgaactattacagc

SEQ ID NO: 74240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacctgtgaactattacag

SEQ ID NO: 74241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttcacctgtgaactatta

SEQ ID NO: 74242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggattgttttcacctgtgaa

SEQ ID NO: 74243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggattgttttcacctgtg

SEQ ID NO: 74244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttctaggattgttttcacc

SEQ ID NO: 74245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttctaggattgttttcac

SEQ ID NO: 74246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttggttctaggattgtttt

SEQ ID NO: 74247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttgcttggttctaggattg

SEQ ID NO: 74248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagttgcttggttctaggat

SEQ ID NO: 74249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagttgcttggttctagga

SEQ ID NO: 74250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctagttgcttggttcta

SEQ ID NO: 74251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cataaattatttctagttgc

SEQ ID NO: 74252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgagtcctccataaattat

SEQ ID NO: 74253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgagtcctccataaatta

SEQ ID NO: 74254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcatgagtcctccataaa

SEQ ID NO: 74255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atggtgtgaaatgtctattt

SEQ ID NO: 74256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aataaatggtgagaagtaaa

SEQ ID NO: 74257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaaataaatggtgagaagt

SEQ ID NO: 74258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctcctaaataaatggtga

SEQ ID NO: 74259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcatctcctaaataaatgg

SEQ ID NO: 74260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgggggcaaagtgtctactc

SEQ ID NO: 74261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccattgtgggggcaaagtgt

SEQ ID NO: 74262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accccccacattcccattgt

SEQ ID NO: 74263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caccccccacattcccattg

SEQ ID NO: 74264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acacttcaccccccacattc

SEQ ID NO: 74265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtctaacacttcacccccc

SEQ ID NO: 74266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtccctgggtctaacacttc

SEQ ID NO: 74267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acaatatgccccaggtccca

SEQ ID NO: 74268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccctgacaatatgccccagg

SEQ ID NO: 74269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcccctgacaatatgcccca

SEQ ID NO: 74270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccctctcccctgacaatatg

SEQ ID NO: 74271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taccctctcccctgacaata

SEQ ID NO: 74272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaccctctcccctgacaat

SEQ ID NO: 74273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttctaccctctcccctga

SEQ ID NO: 74274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgctggcttctaccctctcc

SEQ ID NO: 74275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaactgtgctggcttctac

SEQ ID NO: 74276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaactgtgctggcttcta

SEQ ID NO: 74277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacaaactgtgctggcttct

SEQ ID NO: 74278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataagcaaagatagtcaaag

SEQ ID NO: 74279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taataagcaaagatagtcaa

SEQ ID NO: 74280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaataagcaaagatagtca

SEQ ID NO: 74281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctaataagcaaagatagt

SEQ ID NO: 74282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctcttctaataagcaaaga

SEQ ID NO: 74283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaattgtctcttctaata

SEQ ID NO: 74284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gctcaaaaattgtctcttct

SEQ ID NO: 74285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catattcgctcaaaaattgt

SEQ ID NO: 74286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaattacatattcgctcaa

SEQ ID NO: 74287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaaattacatattcgctca

SEQ ID NO: 74288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataatcttacaaattacat

SEQ ID NO: 74289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcactatataatcttacaaa

SEQ ID NO: 74290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtcactatataatcttaca

SEQ ID NO: 74291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cgtgattctgtcactatata

SEQ ID NO: 74292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acccagagctacgtgattct

SEQ ID NO: 74293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgcagaaaacaaggttaac

SEQ ID NO: 74294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagtaattgatgcagaaaa

SEQ ID NO: 74295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatagtaattgatgcagaaa

SEQ ID NO: 74296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagataagtgatttaatag

SEQ ID NO: 74297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaagataagtgatttaata

SEQ ID NO: 74298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaagataagtgatttaat

SEQ ID NO: 74299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctttcaaagataagtgat

SEQ ID NO: 74300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtgatctgacctttcaaag

SEQ ID NO: 74301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaaatgaaaaaaagaaaac

SEQ ID NO: 74302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaaaatgaaaaaaagaaaa

SEQ ID NO: 74303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcaaaatgaaaaaaagaaa

SEQ ID NO: 74304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataacatggcaaaaatgact

SEQ ID NO: 74305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacacagacattgataacat

SEQ ID NO: 74306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaaacacagacattgataa

SEQ ID NO: 74307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctattaaacacagacattga

SEQ ID NO: 74308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctattaaacacagacattg

SEQ ID NO: 74309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgctattaaacacagaca

SEQ ID NO: 74310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatggataaaattatttg

SEQ ID NO: 74311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaaatggataaaattattt

SEQ ID NO: 74312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgcttaaaaatggataaa

SEQ ID NO: 74313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtgcttaaaaatggataa

SEQ ID NO: 74314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtgcttaaaaatggata

SEQ ID NO: 74315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatgtgcttaaaaatggat

SEQ ID NO: 74316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttatgtgcttaaaaatg

SEQ ID NO: 74317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggaattgtttttatgtgc

SEQ ID NO: 74318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgatggtaaagataacca

SEQ ID NO: 74319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgatggtaaagataacc

SEQ ID NO: 74320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatgatggtaaagataac

SEQ ID NO: 74321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagaccataaaatggtttt

SEQ ID NO: 74322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaagaattcagagaccata

SEQ ID NO: 74323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggaagaattcagagaccat

SEQ ID NO: 74324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaggaagaattcagagacc

SEQ ID NO: 74325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataggcacatgaaattctt

SEQ ID NO: 74326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaataggcacatgaaattct

SEQ ID NO: 74327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcaaccttaaataggcaca

SEQ ID NO: 74328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acataaatctggtcaacctt

SEQ ID NO: 74329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataaaattaacataaatct

SEQ ID NO: 74330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaataaaattaacataaatc

SEQ ID NO: 74331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaataaaattaacataaa

SEQ ID NO: 74332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacagattcttaaataaaat

SEQ ID NO: 74333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtacagattcttaaataa

SEQ ID NO: 74334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgtacagattcttaaata

SEQ ID NO: 74335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgtacagattcttaaat

SEQ ID NO: 74336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttactgtacagattcttaaa

SEQ ID NO: 74337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttactgtacagattctta

SEQ ID NO: 74338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttactgtacagattctt

SEQ ID NO: 74339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggaaggtatgtaataatct

SEQ ID NO: 74340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaaacactgtggaaggtat

SEQ ID NO: 74341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agacagagagcaatgagtag

SEQ ID NO: 74342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatgatcccaacctcagaca

SEQ ID NO: 74343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaggatatgctgaatgatc

SEQ ID NO: 74344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaggatatgctgaatgat

SEQ ID NO: 74345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagaggatatgctgaatga

SEQ ID NO: 74346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctttcagaggatatgctgaa

SEQ ID NO: 74347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctcctttcagaggatatgc

SEQ ID NO: 74348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatctcctttcagaggata

SEQ ID NO: 74349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagttcctatctcctttcag

SEQ ID NO: 74350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggcacgaccaatcaaatac

SEQ ID NO: 74351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggcacgaccaatcaaata

SEQ ID NO: 74352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagggcacgaccaatcaaat

SEQ ID NO: 74353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagggcacgaccaatcaaa

SEQ ID NO: 74354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttagggcacgaccaatcaa

SEQ ID NO: 74355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttagggcacgaccaatca

SEQ ID NO: 74356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttagggcacgaccaatc

SEQ ID NO: 74357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttagggcacgaccaat

SEQ ID NO: 74358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttagggcacgaccaa

SEQ ID NO: 74359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttttttttagggcacga

SEQ ID NO: 74360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgattttttttttagggc

SEQ ID NO: 74361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agacattaattgattttttt

SEQ ID NO: 74362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagacattaattgatttttt

SEQ ID NO: 74363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaagacattaattgatttt

SEQ ID NO: 74364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcttaagacattaattgat

SEQ ID NO: 74365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttcttaagacattaattg

SEQ ID NO: 74366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggattctgttcttaagacat

SEQ ID NO: 74367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaggattctgttcttaaga

SEQ ID NO: 74368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaggattctgttcttaag

SEQ ID NO: 74369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caatttattaggattctgtt

SEQ ID NO: 74370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacctacaatttattaggat

SEQ ID NO: 74371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atacctacaatttattagga

SEQ ID NO: 74372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttatacctacaatttatt

SEQ ID NO: 74373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcttatacctacaatttat

SEQ ID NO: 74374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcttatacctacaattta

SEQ ID NO: 74375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataagcaagattttatctt

SEQ ID NO: 74376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagctatataagcaagattt

SEQ ID NO: 74377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actacagctatataagcaag

SEQ ID NO: 74378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcactacagctatataagc

SEQ ID NO: 74379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attactcactacagctatat

SEQ ID NO: 74380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattactcactacagctata

SEQ ID NO: 74381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattactcactacagctat

SEQ ID NO: 74382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaattactcactacagcta

SEQ ID NO: 74383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttttaattactcactacag

SEQ ID NO: 74384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacttttaattactcactac

SEQ ID NO: 74385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggctctacttttaattactc

SEQ ID NO: 74386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacccagcaatctaggctct

SEQ ID NO: 74387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaacccagcaatctaggctc

SEQ ID NO: 74388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatatacagccagtaagta

SEQ ID NO: 74389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctatgatatacagccagtaa

SEQ ID NO: 74390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcctatgatatacagccagt

SEQ ID NO: 74391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtagctctcctatgatata

SEQ ID NO: 74392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agacagttaagtagctctcc

SEQ ID NO: 74393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaatataaaactgagacag

SEQ ID NO: 74394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accaatataaaactgagaca

SEQ ID NO: 74395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taccaatataaaactgagac

SEQ ID NO: 74396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccccattttaccaatataa

SEQ ID NO: 74397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgattatccccattttacca

SEQ ID NO: 74398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaagaatatgaagcaagca

SEQ ID NO: 74399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcctcacaagaatatgaag

SEQ ID NO: 74400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcctcacaagaatatgaa

SEQ ID NO: 74401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatcctcacaagaatatga

SEQ ID NO: 74402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttaatcctcacaagaata

SEQ ID NO: 74403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcctttaatcctcacaag

SEQ ID NO: 74404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataaatattaattcctttaa

SEQ ID NO: 74405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctcataaatattaattcct

SEQ ID NO: 74406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctcataaatattaattcc

SEQ ID NO: 74407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatctcataaatattaattc

SEQ ID NO: 74408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatctcataaatattaatt

SEQ ID NO: 74409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatctcataaatattaat

SEQ ID NO: 74410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttatctcataaatatt

SEQ ID NO: 74411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttatctcataaatat

SEQ ID NO: 74412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattttttatctcataaata

SEQ ID NO: 74413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctttattttttatctcata

SEQ ID NO: 74414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaaaggcagagaggtgatg

SEQ ID NO: 74415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacactcagaaaggcagaga

SEQ ID NO: 74416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aataaattgaacactcagaa

SEQ ID NO: 74417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctgaataaattgaacactc

SEQ ID NO: 74418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcacatgacaaactatctga

SEQ ID NO: 74419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtaggactgtcacatgac

SEQ ID NO: 74420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgtaggactgtcacatga

SEQ ID NO: 74421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgtaggactgtcacatg

SEQ ID NO: 74422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttcatgtaggactgtcac

SEQ ID NO: 74423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgttttcatgtaggactg

SEQ ID NO: 74424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactgttttcatgtaggact

SEQ ID NO: 74425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcactgttttcatgtaggac

SEQ ID NO: 74426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagcactttcactgttttca

SEQ ID NO: 74427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatacacagcactacagcac

SEQ ID NO: 74428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatacacagcactacagca

SEQ ID NO: 74429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagatacacagcactacagc

SEQ ID NO: 74430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccctttagatacacagcac

SEQ ID NO: 74431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacccctttagatacacagc

SEQ ID NO: 74432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agattctacccctttagata

SEQ ID NO: 74433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagagaatactgagattct

SEQ ID NO: 74434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcagagaatactgagattc

SEQ ID NO: 74435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagaaatttatcagagaata

SEQ ID NO: 74436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aataaaaagtaattccagaa

SEQ ID NO: 74437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctcaataaaaagtaattcc

SEQ ID NO: 74438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttccctcaataaaaagtaat

SEQ ID NO: 74439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgttgttccctcaataaaa

SEQ ID NO: 74440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaatgttgttccctcaat

SEQ ID NO: 74441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattaatgttgttccctcaa

SEQ ID NO: 74442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggagcttcattaatgttg

SEQ ID NO: 74443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcagtaagagacaaccatta

SEQ ID NO: 74444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcagtaagagacaaccatt

SEQ ID NO: 74445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttggcagtaagagacaacc

SEQ ID NO: 74446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttggcagtaagagacaac

SEQ ID NO: 74447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaggtcttccttggcagt

SEQ ID NO: 74448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agttcatgaggtcttccttg

SEQ ID NO: 74449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcagttcatgaggtcttcc

SEQ ID NO: 74450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctcagttcatgaggtctt

SEQ ID NO: 74451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatcatatgctctgctcag

SEQ ID NO: 74452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcatcatatgctctgctca

SEQ ID NO: 74453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtcatttatcatcatatgc

SEQ ID NO: 74454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaactgagtcatttatcatc

SEQ ID NO: 74455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaactgagtcatttatcat

SEQ ID NO: 74456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaactgagtcatttatca

SEQ ID NO: 74457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttcaaactgagtcattta

SEQ ID NO: 74458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcctttcaaactgagtcat

SEQ ID NO: 74459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attgttcctttcaaactgag

SEQ ID NO: 74460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actaattgttcctttcaaac

SEQ ID NO: 74461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactaattgttcctttcaaa

SEQ ID NO: 74462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catttcactaattgttcctt

SEQ ID NO: 74463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccatttcactaattgttcc

SEQ ID NO: 74464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattctccatttcactaatt

SEQ ID NO: 74465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcattctccatttcactaat

SEQ ID NO: 74466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatgtagcttgcattctcc

SEQ ID NO: 74467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagatgtagcttgcattctc

SEQ ID NO: 74468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagatgtagcttgcattct

SEQ ID NO: 74469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttcagatgtagcttgcatt

SEQ ID NO: 74470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagagaggtcacctctttca

SEQ ID NO: 74471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagctgaagagaggtcacct

SEQ ID NO: 74472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagagctgaagagaggtcac

SEQ ID NO: 74473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagagctgaagagaggtca

SEQ ID NO: 74474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catggcaacaatttctagag

SEQ ID NO: 74475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatggcaacaatttctaga

SEQ ID NO: 74476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcatggcaacaatttctag

SEQ ID NO: 74477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcatggcaacaatttcta

SEQ ID NO: 74478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtttttgcatggcaacaa

SEQ ID NO: 74479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcatgagttcatgtttttg

SEQ ID NO: 74480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatgcatgagttcatgttt

SEQ ID NO: 74481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttatgcatgagttcatgtt

SEQ ID NO: 74482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaaaaataaatacacttgt

SEQ ID NO: 74483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcacaaaaataaatacactt

SEQ ID NO: 74484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcacaaaaataaatacact

SEQ ID NO: 74485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcacaaaaataaatacac

SEQ ID NO: 74486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaataagacattttctcac

SEQ ID NO: 74487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaataagacattttctca

SEQ ID NO: 74488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaataagacattttctc

SEQ ID NO: 74489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagttttaaaaataagaca

SEQ ID NO: 74490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaagttttaaaaataagac

SEQ ID NO: 74491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttccaagttttaaaaata

SEQ ID NO: 74492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattagtttccaagttttaa

SEQ ID NO: 74493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattagtttccaagtttta

SEQ ID NO: 74494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttgaattagtttccaag

SEQ ID NO: 74495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatttgaattagtttccaa

SEQ ID NO: 74496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatttgaattagtttcca

SEQ ID NO: 74497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catggaaccaacatagtgtt

SEQ ID NO: 74498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcctgcatggaaccaacata

SEQ ID NO: 74499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggcctgcatggaaccaaca

SEQ ID NO: 74500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggcctgcatggaaccaac

SEQ ID NO: 74501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtatatatgtgtgtgtgag

SEQ ID NO: 74502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtatatatgtgtgtgtga

SEQ ID NO: 74503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtgtatatatgtgtgtg

SEQ ID NO: 74504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatagttgtttgtgtatata

SEQ ID NO: 74505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagttgtatagttgtttgtg

SEQ ID NO: 74506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatatataccacataccac

SEQ ID NO: 74507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatatataccacatacca

SEQ ID NO: 74508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaatatatatttaaaatat

SEQ ID NO: 74509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaatctagaaatatatatt

SEQ ID NO: 74510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaatctagaaatatatat

SEQ ID NO: 74511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacaaatctagaaatatata

SEQ ID NO: 74512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacaactttacaaatctaga

SEQ ID NO: 74513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacaactatacaactttaca

SEQ ID NO: 74514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacctatacaactatacaac

SEQ ID NO: 74515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atacacatacatgcatgact

SEQ ID NO: 74516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatacacatacatgcatgac

SEQ ID NO: 74517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatacacatacatgcatga

SEQ ID NO: 74518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttttgatacacatacatg

SEQ ID NO: 74519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatgtctgtgttttgataca

SEQ ID NO: 74520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcctgtatgtctgtgtttt

SEQ ID NO: 74521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatacacatagatgcataa

SEQ ID NO: 74522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcacatacacatagatgca

SEQ ID NO: 74523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatgggtgtgtctgttcac

SEQ ID NO: 74524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaaatgggtgtgtctgttc

SEQ ID NO: 74525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagagatctctcaaatgggt

SEQ ID NO: 74526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagagatctctcaaatggg

SEQ ID NO: 74527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacagagatctctcaaatgg

SEQ ID NO: 74528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacagagatctctcaaatg

SEQ ID NO: 74529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttacagagatctctcaaat

SEQ ID NO: 74530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttttacagagatctctc

SEQ ID NO: 74531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaagttgactttttacag

SEQ ID NO: 74532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaaagttgactttttaca

SEQ ID NO: 74533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaaaagttgactttttac

SEQ ID NO: 74534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcaaaaagttgacttttta

SEQ ID NO: 74535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gagacttttcaaaaagttga

SEQ ID NO: 74536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgagacttttcaaaaagttg

SEQ ID NO: 74537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgagacttttcaaaaagtt

SEQ ID NO: 74538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttttcgagacttttcaaaa

SEQ ID NO: 74539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagcacagaaaacctggttt

SEQ ID NO: 74540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagactatagcacagaaaa

SEQ ID NO: 74541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacagactatagcacagaaa

SEQ ID NO: 74542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgacagactatagcacag

SEQ ID NO: 74543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttgacagactatagcaca

SEQ ID NO: 74544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtttgacagactatagca

SEQ ID NO: 74545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acaaattcttgtttgacaga

SEQ ID NO: 74546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctgacaaattcttgtttg

SEQ ID NO: 74547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatctgacaaattcttgttt

SEQ ID NO: 74548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaatctgacaaattcttg

SEQ ID NO: 74549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttaatctgacaaattctt

SEQ ID NO: 74550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catggaaaataatttgttta

SEQ ID NO: 74551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaacatgtctacatggaaaa

SEQ ID NO: 74552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacctgaaacatgtctacat

SEQ ID NO: 74553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatacctgaaacatgtctac

SEQ ID NO: 74554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataacgtcatctctatacct

SEQ ID NO: 74555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cataactaataacgtcatct

SEQ ID NO: 74556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgaaaacactgcataact

SEQ ID NO: 74557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgaaaacactgcataac

SEQ ID NO: 74558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggcacaatatatggtttat

SEQ ID NO: 74559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagatacaatggaaataca

SEQ ID NO: 74560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataagatacaatggaaatac

SEQ ID NO: 74561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtggatacttataagataca

SEQ ID NO: 74562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaggaattagtggatactta

SEQ ID NO: 74563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaactagaggaattagtg

SEQ ID NO: 74564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagtgaaaactacaaaacta

SEQ ID NO: 74565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accatagaaaaatcagtatc

SEQ ID NO: 74566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccatagaaaaatcagtat

SEQ ID NO: 74567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaccatagaaaaatcagta

SEQ ID NO: 74568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaccatagaaaaatcagt

SEQ ID NO: 74569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcaccatagaaaaatcag

SEQ ID NO: 74570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagttttttcaccatagaa

SEQ ID NO: 74571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagagttttttcaccataga

SEQ ID NO: 74572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttaagagttttttcacca

SEQ ID NO: 74573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catttaagagttttttcacc

SEQ ID NO: 74574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcatttaagagttttttca

SEQ ID NO: 74575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcatttaagagttttttc

SEQ ID NO: 74576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaagtttcttcatttaag

SEQ ID NO: 74577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgaagtttcttcatttaa

SEQ ID NO: 74578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgaagtttcttcattta

SEQ ID NO: 74579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatgaagtttcttcattt

SEQ ID NO: 74580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatttttaatgaagtttct

SEQ ID NO: 74581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatttttaatgaagtttc

SEQ ID NO: 74582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcatatttttaatgaagt

SEQ ID NO: 74583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagattatttcatattttt

SEQ ID NO: 74584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcagattaggagattatt

SEQ ID NO: 74585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatcagattaggagattat

SEQ ID NO: 74586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataatttatatcagattag

SEQ ID NO: 74587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgtgtaatatgtaaaata

SEQ ID NO: 74588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caattatgtgtgtaatatgt

SEQ ID NO: 74589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaattatgtgtgtaatatg

SEQ ID NO: 74590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcaattatgtgtgtaatat

SEQ ID NO: 74591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttgcaattatgtgtgtaa

SEQ ID NO: 74592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttgcaattatgtgtgta

SEQ ID NO: 74593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttgcaattatgtgtgt

SEQ ID NO: 74594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattttgttttgcaattatg

SEQ ID NO: 74595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcattttgttttgcaattat

SEQ ID NO: 74596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgcattttgttttgcaat

SEQ ID NO: 74597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttgcattttgttttgcaa

SEQ ID NO: 74598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcttgcattttgttttgca

SEQ ID NO: 74599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggaatcaaactttgcttgc

SEQ ID NO: 74600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtggaatcaaactttgctt

SEQ ID NO: 74601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtggaatcaaactttgct

SEQ ID NO: 74602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttctgtggaatcaaact

SEQ ID NO: 74603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgagcatgttaaatttct

SEQ ID NO: 74604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaatgagcatgttaaatt

SEQ ID NO: 74605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attattgaatgagcatgtta

SEQ ID NO: 74606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattattgaatgagcatgtt

SEQ ID NO: 74607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattattgaatgagcatgt

SEQ ID NO: 74608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcattattgaatgagcatg

SEQ ID NO: 74609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaggtatttttcattattg

SEQ ID NO: 74610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcaaggtatttttcattat

SEQ ID NO: 74611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgcaaggtatttttcatta

SEQ ID NO: 74612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcccttctgcaaggtattt

SEQ ID NO: 74613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagcccttctgcaaggtatt

SEQ ID NO: 74614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgtgcatgatacagctta

SEQ ID NO: 74615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatgtgtgcatgatacagct

SEQ ID NO: 74616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtaacatgtgacctctatg

SEQ ID NO: 74617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtaacatgtgacctctat

SEQ ID NO: 74618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggtaacatgtgacctcta

SEQ ID NO: 74619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaggtaacatgtgacctct

SEQ ID NO: 74620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aataaatgcatgtgctttta

SEQ ID NO: 74621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaataaatgcatgtgctttt

SEQ ID NO: 74622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatttgaataaatgcatgtg

SEQ ID NO: 74623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatttgaataaatgcatgt

SEQ ID NO: 74624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catcaaatccatggccacac

SEQ ID NO: 74625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtgagagtaaagttccat

SEQ ID NO: 74626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagtgagagtaaagttcca

SEQ ID NO: 74627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagacaatgtagtatttcaa

SEQ ID NO: 74628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagacaatgtagtatttca

SEQ ID NO: 74629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttgcagacaatgtagta

SEQ ID NO: 74630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttgcagacaatgtagt

SEQ ID NO: 74631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatttatatttgcagaca

SEQ ID NO: 74632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatatttatatttgcagac

SEQ ID NO: 74633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgcttatatatttatatt

SEQ ID NO: 74634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaacatatgctacatgctta

SEQ ID NO: 74635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaacatatgctacatgctt

SEQ ID NO: 74636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acccaataagcttcaaacat

SEQ ID NO: 74637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actaacccaataagcttcaa

SEQ ID NO: 74638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactaacccaataagcttca

SEQ ID NO: 74639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgactaacccaataagcttc

SEQ ID NO: 74640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaatatcagcaagggcttt

SEQ ID NO: 74641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattaccaatatcagcaagg

SEQ ID NO: 74642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgctgcattaccaatatcag

SEQ ID NO: 74643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgctatgctgcattaccaat

SEQ ID NO: 74644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actatgctatgctgcattac

SEQ ID NO: 74645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcccactcactatgctatgc

SEQ ID NO: 74646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcccactcactatgctatg

SEQ ID NO: 74647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagcccactcactatgctat

SEQ ID NO: 74648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttagcccactcactatgct

SEQ ID NO: 74649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caggatatctctttagccca

SEQ ID NO: 74650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaggatatctctttagccc

SEQ ID NO: 74651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtttccaggatatctctt

SEQ ID NO: 74652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggagtttccaggatatct

SEQ ID NO: 74653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attcctggagtttccaggat

SEQ ID NO: 74654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcattcctggagtttccagg

SEQ ID NO: 74655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcattcctggagtttccag

SEQ ID NO: 74656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcattcctggagtttcca

SEQ ID NO: 74657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagtgagatctttctcatt

SEQ ID NO: 74658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaagtgagatctttctcat

SEQ ID NO: 74659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcttgaaagtgagatcttt

SEQ ID NO: 74660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attaggcttgaaagtgagat

SEQ ID NO: 74661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagaaaggtgtctgattagg

SEQ ID NO: 74662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtggttagagaaaggtgtc

SEQ ID NO: 74663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cgagtcactaagtggttaga

SEQ ID NO: 74664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaggtctacgagtcacta

SEQ ID NO: 74665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagcagttccaaaggtctac

SEQ ID NO: 74666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagcagttccaaaggtcta

SEQ ID NO: 74667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacagcagttccaaaggtct

SEQ ID NO: 74668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acacaaacaaacataaaagc

SEQ ID NO: 74669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatgcaagcattgacacaa

SEQ ID NO: 74670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaatcaaaacaaaatatct

SEQ ID NO: 74671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtctatgaatcaaaacaa

SEQ ID NO: 74672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctggagtctatgaatcaa

SEQ ID NO: 74673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catctggagtctatgaatca

SEQ ID NO: 74674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaatatttcatctggagt

SEQ ID NO: 74675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaatatttcatctggag

SEQ ID NO: 74676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaatatttcatctgga

SEQ ID NO: 74677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaaatatttcatctgg

SEQ ID NO: 74678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttaaaaaatatttcat

SEQ ID NO: 74679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttttaaaaaatatttca

SEQ ID NO: 74680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatttttaaaaaatatttc

SEQ ID NO: 74681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttcatttttaaaaaatat

SEQ ID NO: 74682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catataaatgaaacataact

SEQ ID NO: 74683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtcctccatataaatgaaa

SEQ ID NO: 74684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtattaggtcctccatata

SEQ ID NO: 74685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatggctatgtattaggtc

SEQ ID NO: 74686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaatggctatgtattaggt

SEQ ID NO: 74687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaaatttagaatggctat

SEQ ID NO: 74688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaaaaatttagaatggcta

SEQ ID NO: 74689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttgaaaaaatttagaatg

SEQ ID NO: 74690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcttgaaaaaatttagaat

SEQ ID NO: 74691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatcttgaaaaaatttaga

SEQ ID NO: 74692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttatcttgaaaaaatttag

SEQ ID NO: 74693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caatgtgcagtaggcttctt

SEQ ID NO: 74694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccaatgtgcagtaggcttc

SEQ ID NO: 74695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctctccaatgtgcagtagg

SEQ ID NO: 74696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctatctctccaatgtgcagt

SEQ ID NO: 74697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctatctctccaatgtgca

SEQ ID NO: 74698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actctgctatctctccaatg

SEQ ID NO: 74699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accactcactctgctatctc

SEQ ID NO: 74700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaccactcactctgctatct

SEQ ID NO: 74701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaaccactcactctgctat

SEQ ID NO: 74702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgctcttaaccactcactct

SEQ ID NO: 74703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgctcttaaccactcactc

SEQ ID NO: 74704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatcttgtgctcttaacca

SEQ ID NO: 74705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagatcttgtgctcttaacc

SEQ ID NO: 74706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttcagatcttgtgctctta

SEQ ID NO: 74707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctgtttcagatcttgtgct

SEQ ID NO: 74708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaacggaggctgtctgtttc

SEQ ID NO: 74709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agttgaaacggaggctgtct

SEQ ID NO: 74710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaagttgaaacggaggctg

SEQ ID NO: 74711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataaatggtagctcctaagt

SEQ ID NO: 74712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agctaataaatggtagctcc

SEQ ID NO: 74713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcagctaataaatggtagc

SEQ ID NO: 74714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcagctaataaatggtag

SEQ ID NO: 74715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccccaatttactcagctaat

SEQ ID NO: 74716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccccaatttactcagctaa

SEQ ID NO: 74717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggcatggggaaatgaagca

SEQ ID NO: 74718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaatgggaaaattgaggca

SEQ ID NO: 74719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaatgggaaaattgaggc

SEQ ID NO: 74720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaaatgggaaaattgagg

SEQ ID NO: 74721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttacaaatgggaaaattg

SEQ ID NO: 74722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttttacaaatgggaaaat

SEQ ID NO: 74723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctctgttttacaaatggga

SEQ ID NO: 74724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatctctgttttacaaatg

SEQ ID NO: 74725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgacaaccccatgagatgat

SEQ ID NO: 74726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgacaaccccatgagatga

SEQ ID NO: 74727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatttatgacaaccccatg

SEQ ID NO: 74728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtatttatgacaaccccat

SEQ ID NO: 74729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataacagcaaacacatattt

SEQ ID NO: 74730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaataacagcaaacacata

SEQ ID NO: 74731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttgttaataacagcaaac

SEQ ID NO: 74732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagttgttaataacagcaaa

SEQ ID NO: 74733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgagttgttaataacagc

SEQ ID NO: 74734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttgagttgttaataacag

SEQ ID NO: 74735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaggaatcttatttgagtt

SEQ ID NO: 74736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttccaaggaatcttatttga

SEQ ID NO: 74737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatgtacctattccaagga

SEQ ID NO: 74738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatatgtacctattccaagg

SEQ ID NO: 74739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggtcacagcttaatatgta

SEQ ID NO: 74740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggtcacagcttaatatgt

SEQ ID NO: 74741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaggtcacagcttaatatg

SEQ ID NO: 74742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaggtcacagcttaatat

SEQ ID NO: 74743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcaggtcacagcttaata

SEQ ID NO: 74744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctttttcaggtcacagctt

SEQ ID NO: 74745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctatctttttcaggtcacag

SEQ ID NO: 74746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgctatctttttcaggtca

SEQ ID NO: 74747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccagctactgctatcttttt

SEQ ID NO: 74748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccagctactgctatctttt

SEQ ID NO: 74749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgccagctactgctatct

SEQ ID NO: 74750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattacttgccagctactgc

SEQ ID NO: 74751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggattacttgccagctactg

SEQ ID NO: 74752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaagaaatttggattactt

SEQ ID NO: 74753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgaagaaatttggattac

SEQ ID NO: 74754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatgaagaaatttggatta

SEQ ID NO: 74755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatagatcccatttctat

SEQ ID NO: 74756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttaataatagatcccattt

SEQ ID NO: 74757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atattagttaataatagatc

SEQ ID NO: 74758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgacggatacatatatagat

SEQ ID NO: 74759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgacggatacatatataga

SEQ ID NO: 74760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagaacaatttatgacggat

SEQ ID NO: 74761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagaacaatttatgacgga

SEQ ID NO: 74762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagagaacaatttatgacgg

SEQ ID NO: 74763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttagagaacaatttatgac

SEQ ID NO: 74764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaataatctctttagagaa

SEQ ID NO: 74765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagattataaataatctctt

SEQ ID NO: 74766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattgaagattataaataa

SEQ ID NO: 74767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataattgaagattataaata

SEQ ID NO: 74768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataattgaagattataaat

SEQ ID NO: 74769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttataattgaagattat

SEQ ID NO: 74770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaattttataattgaagat

SEQ ID NO: 74771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctattaattttataattga

SEQ ID NO: 74772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtctattaattttataattg

SEQ ID NO: 74773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaaaaggtacttgtctatt

SEQ ID NO: 74774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaaaaggtacttgtctat

SEQ ID NO: 74775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaaaaaggtacttgtcta

SEQ ID NO: 74776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtaaaaaggtacttgtct

SEQ ID NO: 74777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagataaaatcccattttt

SEQ ID NO: 74778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actcaaagataaaatcccat

SEQ ID NO: 74779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taggcatctaactcaaagat

SEQ ID NO: 74780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgttgtaggcatctaact

SEQ ID NO: 74781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgtgttgtaggcatctaa

SEQ ID NO: 74782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attctatgtgttgtaggcat

SEQ ID NO: 74783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcctcattctatgtgttgt

SEQ ID NO: 74784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcctaatcctcattctatgt

SEQ ID NO: 74785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attagcctaatcctcattct

SEQ ID NO: 74786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attcattagcctaatcctca

SEQ ID NO: 74787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattcattagcctaatcctc

SEQ ID NO: 74788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgattcattagcctaatcct

SEQ ID NO: 74789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggaacacacctttgattc

SEQ ID NO: 74790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataggaacacacctttgat

SEQ ID NO: 74791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctataggaacacacctttga

SEQ ID NO: 74792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctataggaacacacctttg

SEQ ID NO: 74793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctataggaacacaccttt

SEQ ID NO: 74794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctataggaacacacctt

SEQ ID NO: 74795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatactttttctataggaa

SEQ ID NO: 74796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaatactttttctatagga

SEQ ID NO: 74797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcaatactttttctatagg

SEQ ID NO: 74798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattttgcaatactttttct

SEQ ID NO: 74799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcattttgcaatacttttt

SEQ ID NO: 74800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaatggctctgcattttgc

SEQ ID NO: 74801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgaatggctctgcattttg

SEQ ID NO: 74802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcttgtgaatggctctgca

SEQ ID NO: 74803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggtcttgtgaatggctctg

SEQ ID NO: 74804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctggtcttgtgaatggctc

SEQ ID NO: 74805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctggtcttgtgaatggct

SEQ ID NO: 74806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagggccttctctggtcttg

SEQ ID NO: 74807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgaagggccttctctggtc

SEQ ID NO: 74808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctgaagggccttctctgg

SEQ ID NO: 74809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgctgaagggccttctct

SEQ ID NO: 74810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catcagtcagtctctctgct

SEQ ID NO: 74811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgcatcagtcagtctctct

SEQ ID NO: 74812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcctgcatcagtcagtctc

SEQ ID NO: 74813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttcctgcatcagtcagtct

SEQ ID NO: 74814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcccttgttcctgcatcag

SEQ ID NO: 74815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggcatggctgggcccttgt

SEQ ID NO: 74816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catagctcaggcatggctgg

SEQ ID NO: 74817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatagctcaggcatggctg

SEQ ID NO: 74818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacatagctcaggcatggct

SEQ ID NO: 74819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgacagcgtaaggacgttt

SEQ ID NO: 74820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatgacagcgtaaggacgt

SEQ ID NO: 74821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgatgacagcgtaaggacg

SEQ ID NO: 74822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccagaggtgataatagataa

SEQ ID NO: 74823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgccagaggtgataatagat

SEQ ID NO: 74824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgccagaggtgataataga

SEQ ID NO: 74825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccaatggacagcttctgcc

SEQ ID NO: 74826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgctccccaatggacagct

SEQ ID NO: 74827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agccctcatgctccccaatg

SEQ ID NO: 74828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggacgctcagccctcatg

SEQ ID NO: 74829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttgatggacgctcagccct

SEQ ID NO: 74830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctggttgatggacgctcag

SEQ ID NO: 74831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caacggtgtggtctccctgg

SEQ ID NO: 74832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggactgcaacggtgtggtc

SEQ ID NO: 74833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccggtgaacgggaaaatgca

SEQ ID NO: 74834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgccccacagaccccaggag

SEQ ID NO: 74835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgccccacagaccccagga

SEQ ID NO: 74836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgtgccccacagacccca

SEQ ID NO: 74837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgtttgtgccccacagac

SEQ ID NO: 74838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagacaatgagagcagaagg

SEQ ID NO: 74839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggagacaatgagagcagaag

SEQ ID NO: 74840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggagacaatgagagcagaa

SEQ ID NO: 74841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggagacaatgagagcaga

SEQ ID NO: 74842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccgatgatgagcacagcatt

SEQ ID NO: 74843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccgatgatgagcacagcat

SEQ ID NO: 74844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatttgccgatgatgagcac

SEQ ID NO: 74845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agactgaatttgccgatgat

SEQ ID NO: 74846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaggcagaggaagagatat

SEQ ID NO: 74847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaggcagaggaagagata

SEQ ID NO: 74848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttcaaaggcagaggaaga

SEQ ID NO: 74849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttcaaaggcagaggaag

SEQ ID NO: 74850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtttcaaaggcagaggaa

SEQ ID NO: 74851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtttcaaaggcagagga

SEQ ID NO: 74852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttagtttcaaaggcagagg

SEQ ID NO: 74853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaggcgaagcagcagaaca

SEQ ID NO: 74854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcaaggcgaagcagcagaa

SEQ ID NO: 74855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcaaggcgaagcagcaga

SEQ ID NO: 74856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgcaaggcgaagcagcag

SEQ ID NO: 74857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttctgcaaggcgaagcag

SEQ ID NO: 74858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttttctgcaaggcgaagca

SEQ ID NO: 74859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttgttttctgcaaggcgaa

SEQ ID NO: 74860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtggctccttgttttctgca

SEQ ID NO: 74861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcattcgtggctccttgtt

SEQ ID NO: 74862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagtcaccactcagcattcg

SEQ ID NO: 74863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcagtcaccactcagcatt

SEQ ID NO: 74864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcagtcaccactcagcat

SEQ ID NO: 74865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgcagtcaccactcagca

SEQ ID NO: 74866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgcagtcaccactcagc

SEQ ID NO: 74867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttctgcagtcaccact

SEQ ID NO: 74868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttttctgcagtcaccac

SEQ ID NO: 74869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatttttctgcagtcacca

SEQ ID NO: 74870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatttttctgcagtcacc

SEQ ID NO: 74871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaatttttctgcagtcac

SEQ ID NO: 74872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaatttttctgcagtca

SEQ ID NO: 74873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaatttttctgcagtc

SEQ ID NO: 74874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcaaccacgttttttttaa

SEQ ID NO: 74875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagcaaccacgtttttttta

SEQ ID NO: 74876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcagtaggtgcttcagcaac

SEQ ID NO: 74877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatcagtaggtgcttcagca

SEQ ID NO: 74878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatcagtaggtgcttcagc

SEQ ID NO: 74879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgaagtgtacttctatca

SEQ ID NO: 74880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgaagtgtacttctatc

SEQ ID NO: 74881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtggtatttatatgaagtg

SEQ ID NO: 74882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggccagtgggttcagtggt

SEQ ID NO: 74883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccctcaggccagtgggttca

SEQ ID NO: 74884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtcagtacagagccacctg

SEQ ID NO: 74885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtcagtacagagccacct

SEQ ID NO: 74886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtcagtacagagccacc

SEQ ID NO: 74887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaagtcagtacagagccac

SEQ ID NO: 74888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttaagtcagtacagagcc

SEQ ID NO: 74889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttaagtcagtacagagc

SEQ ID NO: 74890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtatgtttcttttaagtca

SEQ ID NO: 74891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtatgtttcttttaagtc

SEQ ID NO: 74892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtatgtttcttttaagt

SEQ ID NO: 74893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagtatgtttcttttaag

SEQ ID NO: 74894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtttttaagtatgtttcttt

SEQ ID NO: 74895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgtttttaagtatgtttctt

SEQ ID NO: 74896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttcgtttttaagtatgttt

SEQ ID NO: 74897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattgcttcgtttttaagta

SEQ ID NO: 74898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgaattgcttcgttttta

SEQ ID NO: 74899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcactgaattgcttcgtttt

SEQ ID NO: 74900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcactgaattgcttcgttt

SEQ ID NO: 74901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctcactgaattgcttcgt

SEQ ID NO: 74902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctcactgaattgcttcg

SEQ ID NO: 74903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttctcactgaattgcttc

SEQ ID NO: 74904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtggaagaagttttcttct

SEQ ID NO: 74905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagtggaagaagttttcttc

SEQ ID NO: 74906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcccttaagtggaagaagt

SEQ ID NO: 74907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcccttaagtggaagaag

SEQ ID NO: 74908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcatcccttaagtggaag

SEQ ID NO: 74909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaattgtttcatcccttaa

SEQ ID NO: 74910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaaattgtttcatccctt

SEQ ID NO: 74911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaggatgaattctacaaat

SEQ ID NO: 74912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcctgaaaggatgaattct

SEQ ID NO: 74913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctggtcctgaaaggatgaa

SEQ ID NO: 74914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctggtcctgaaaggatga

SEQ ID NO: 74915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatagcaacaaataatttac

SEQ ID NO: 74916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagagctgtatagcaacaaa

SEQ ID NO: 74917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggccagaatattagagagct

SEQ ID NO: 74918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taggccagaatattagagag

SEQ ID NO: 74919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagaatggagcagtaactc

SEQ ID NO: 74920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcagcaaaatgaatggcat

SEQ ID NO: 74921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgcagcaaaatgaatggc

SEQ ID NO: 74922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagttctgtgcagcaaaat

SEQ ID NO: 74923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttataagttctgtgcagc

SEQ ID NO: 74924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagttataagttctgtgcag

SEQ ID NO: 74925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagttataagttctgtgca

SEQ ID NO: 74926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagttataagttctgtgc

SEQ ID NO: 74927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaagttataagttctgtg

SEQ ID NO: 74928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaagttataagttctgt

SEQ ID NO: 74929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttaagttataagttctg

SEQ ID NO: 74930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttttaagttataagttc

SEQ ID NO: 74931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agttctttttttaagttata

SEQ ID NO: 74932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgaccagtagcaatacta

SEQ ID NO: 74933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatataaaaagttgaatga

SEQ ID NO: 74934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggattgatatataaaaagt

SEQ ID NO: 74935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaagcctggggattgatat

SEQ ID NO: 74936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgaagcctggggattgata

SEQ ID NO: 74937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgaagcctggggattgat

SEQ ID NO: 74938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgaagcctggggattga

SEQ ID NO: 74939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtgaagcctggggattg

SEQ ID NO: 74940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgtgaagcctggggatt

SEQ ID NO: 74941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caatttttttgtgaagcctg

SEQ ID NO: 74942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaatttttttgtgaagcct

SEQ ID NO: 74943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgcaaagaaccatacagc

SEQ ID NO: 74944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatgcaaagaaccatacag

SEQ ID NO: 74945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaatgcaaagaaccataca

SEQ ID NO: 74946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatgtaaggtggattttca

SEQ ID NO: 74947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtatgtaaggtggattttc

SEQ ID NO: 74948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttagtatgtaaggtggattt

SEQ ID NO: 74949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agctcttagtatgtaaggtg

SEQ ID NO: 74950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actgagctcttagtatgtaa

SEQ ID NO: 74951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactgagctcttagtatgta

SEQ ID NO: 74952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taactgagctcttagtatgt

SEQ ID NO: 74953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatacactttaactgagctc

SEQ ID NO: 74954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatacactttaactgagct

SEQ ID NO: 74955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatacactttaactgagc

SEQ ID NO: 74956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttaaatacactttaactga

SEQ ID NO: 74957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctttaaatacactttaact

SEQ ID NO: 74958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagctctctttaaatacac

SEQ ID NO: 74959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgctaaaagctctctttaa

SEQ ID NO: 74960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actggtgctaaaagctctct

SEQ ID NO: 74961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaattaactggtgctaaaa

SEQ ID NO: 74962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaattaactggtgctaaa

SEQ ID NO: 74963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tataaattaactggtgctaa

SEQ ID NO: 74964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgactttataaattaactg

SEQ ID NO: 74965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgactttataaattaact

SEQ ID NO: 74966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatttaatgactttataa

SEQ ID NO: 74967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatatttaatgactttata

SEQ ID NO: 74968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatatttaatgactttat

SEQ ID NO: 74969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatatttaatgacttta

SEQ ID NO: 74970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaaatatttaatgacttt

SEQ ID NO: 74971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttaaatatttaatgact

SEQ ID NO: 74972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttttaaatatttaatgac

SEQ ID NO: 74973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggcaacttctttttaaatat

SEQ ID NO: 74974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtattgggcaacttcttttt

SEQ ID NO: 74975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtattgggcaacttctttt

SEQ ID NO: 74976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtattgggcaacttcttt

SEQ ID NO: 74977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttggtattgggcaacttct

SEQ ID NO: 74978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctttggtattgggcaact

SEQ ID NO: 74979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcctctttggtattgggca

SEQ ID NO: 74980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcctctttggtattgggc

SEQ ID NO: 74981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctcctctttggtattggg

SEQ ID NO: 74982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcctcctctttggtattgg

SEQ ID NO: 74983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatttttcctcctctttggt

SEQ ID NO: 74984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacatgagtcatataagcat

SEQ ID NO: 74985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caccctggacatgagtcata

SEQ ID NO: 74986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaccctggacatgagtcat

SEQ ID NO: 74987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaggatttacaccctgga

SEQ ID NO: 74988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaaaggatttacaccctgg

SEQ ID NO: 74989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatccttccaaaggatttac

SEQ ID NO: 74990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactagatccttccaaagga

SEQ ID NO: 74991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgaactagatccttccaaa

SEQ ID NO: 74992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgtctattgaactagatcc

SEQ ID NO: 74993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catagtaagcactaatgtct

SEQ ID NO: 74994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatagtaagcactaatgtc

SEQ ID NO: 74995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacatagtaagcactaatgt

SEQ ID NO: 74996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttacatagtaagcactaat

SEQ ID NO: 74997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctttacatagtaagcact

SEQ ID NO: 74998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttctttacatagtaagcac

SEQ ID NO: 74999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttctttacatagtaagca

SEQ ID NO: 75000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccactttgttctttacatag

SEQ ID NO: 75001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaatagttgccactttgtt

SEQ ID NO: 75002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcacaatagttgccacttt

SEQ ID NO: 75003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattgttcacaatagttgcc

SEQ ID NO: 75004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccattgttcacaatagttgc

SEQ ID NO: 75005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccattgttcacaatagttg

SEQ ID NO: 75006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccattgttcacaatagtt

SEQ ID NO: 75007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttccattgttcacaatagt

SEQ ID NO: 75008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatactttttccattgttc

SEQ ID NO: 75009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accatactttttccattgtt

SEQ ID NO: 75010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggcaaagaccttaccatac

SEQ ID NO: 75011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggcaaagaccttaccata

SEQ ID NO: 75012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaggcaaagaccttaccat

SEQ ID NO: 75013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttttgaggcaaagacctta

SEQ ID NO: 75014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacacatatatcaataaaaa

SEQ ID NO: 75015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggacacatatatcaataaaa

SEQ ID NO: 75016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtgatgatacagaacttgg

SEQ ID NO: 75017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacctaggtgatgatacaga

SEQ ID NO: 75018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaacctaggtgatgatacag

SEQ ID NO: 75019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttgaacctaggtgatgat

SEQ ID NO: 75020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacttgaacctaggtgatga

SEQ ID NO: 75021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatttcacttgaacctag

SEQ ID NO: 75022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaaatttcacttgaaccta

SEQ ID NO: 75023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccttcaaaatttcacttgaa

SEQ ID NO: 75024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatacacagtaaaaaaaga

SEQ ID NO: 75025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgatatacacagtaaaaaa

SEQ ID NO: 75026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctgatatacacagtaaaa

SEQ ID NO: 75027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caagattctcctgatataca

SEQ ID NO: 75028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatctacaagattctcct

SEQ ID NO: 75029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttaaaaatctacaagattc

SEQ ID NO: 75030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatctagttaaaaatcta

SEQ ID NO: 75031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactaaaaatctagttaaaa

SEQ ID NO: 75032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaactaaaaatctagttaa

SEQ ID NO: 75033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaactaaaaatctagtta

SEQ ID NO: 75034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaaactaaaaatctagtt

SEQ ID NO: 75035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctaaactaaaaatctagt

SEQ ID NO: 75036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catcacacaaccccacaaat

SEQ ID NO: 75037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatcacacaaccccacaaa

SEQ ID NO: 75038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatcacacaaccccacaa

SEQ ID NO: 75039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttccatcacacaacccca

SEQ ID NO: 75040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgttttccatcacacaac

SEQ ID NO: 75041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctgttttccatcacacaa

SEQ ID NO: 75042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtcttccctgttttccatc

SEQ ID NO: 75043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggtcttccctgttttccat

SEQ ID NO: 75044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttaggtcttccctgttttc

SEQ ID NO: 75045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttaggtcttccctgtttt

SEQ ID NO: 75046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttaggtcttccctgttt

SEQ ID NO: 75047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttccttaggtcttccctg

SEQ ID NO: 75048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttttccttaggtcttccc

SEQ ID NO: 75049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgttttccttaggtcttcc

SEQ ID NO: 75050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttctgttttccttaggtct

SEQ ID NO: 75051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacaaatccccaagatgaac

SEQ ID NO: 75052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcacaaatccccaagatga

SEQ ID NO: 75053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattctgcacaaatcccca

SEQ ID NO: 75054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataattctgcacaaatcccc

SEQ ID NO: 75055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttataattctgcacaaatc

SEQ ID NO: 75056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctgcttataattctgcaca

SEQ ID NO: 75057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggcctccctgcttataatt

SEQ ID NO: 75058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaggcctccctgcttataa

SEQ ID NO: 75059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctctcaggcctccctgct

SEQ ID NO: 75060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catctctcaggcctccctgc

SEQ ID NO: 75061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaccttcatctctcaggcc

SEQ ID NO: 75062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgaaaccttcatctctca

SEQ ID NO: 75063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactgaaaccttcatctctc

SEQ ID NO: 75064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcactgaaaccttcatctct

SEQ ID NO: 75065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcactgaaaccttcatctc

SEQ ID NO: 75066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttcactgaaaccttcatc

SEQ ID NO: 75067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttttcactgaaaccttca

SEQ ID NO: 75068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttttcactgaaaccttc

SEQ ID NO: 75069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcttttcactgaaacctt

SEQ ID NO: 75070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctttctcttttcactgaaa

SEQ ID NO: 75071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctttctcttttcactgaa

SEQ ID NO: 75072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccctttctcttttcactga

SEQ ID NO: 75073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttccctttctcttttcact

SEQ ID NO: 75074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttccctttctcttttca

SEQ ID NO: 75075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtggaagttctctttccct

SEQ ID NO: 75076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtggaagttctctttccc

SEQ ID NO: 75077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttatgtggaagttctcttt

SEQ ID NO: 75078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttatgtggaagttctct

SEQ ID NO: 75079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attctgtttatgtggaagtt

SEQ ID NO: 75080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaattctgtttatgtggaa

SEQ ID NO: 75081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatgtagtgccatagtctg

SEQ ID NO: 75082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaatatgtagtgccatagt

SEQ ID NO: 75083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacccccaaccacatcaact

SEQ ID NO: 75084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatcctccacccccaacca

SEQ ID NO: 75085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatatcctccacccccaacc

SEQ ID NO: 75086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatatcctccacccccaac

SEQ ID NO: 75087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagaagcctttgatatcctc

SEQ ID NO: 75088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggagaagcctttgatatcct

SEQ ID NO: 75089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggagaagcctttgatatcc

SEQ ID NO: 75090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaactttggagaagcctttg

SEQ ID NO: 75091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaactttggagaagccttt

SEQ ID NO: 75092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acccatttggaactttggag

SEQ ID NO: 75093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacagtataggtaatagtat

SEQ ID NO: 75094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaacagtataggtaatagta

SEQ ID NO: 75095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaacagtataggtaatag

SEQ ID NO: 75096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaaacagtataggtaata

SEQ ID NO: 75097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttaaacagtataggtaat

SEQ ID NO: 75098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcttaaacagtataggta

SEQ ID NO: 75099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttcttaaacagtataggt

SEQ ID NO: 75100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctttcttaaacagtatag

SEQ ID NO: 75101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttctttcttaaacagtat

SEQ ID NO: 75102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttctttcttaaacagta

SEQ ID NO: 75103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttctcttctttcttaaac

SEQ ID NO: 75104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gactagtttctcttctttct

SEQ ID NO: 75105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agactagtttctcttctttc

SEQ ID NO: 75106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcttagactagtttctctt

SEQ ID NO: 75107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaactaatcttagactagt

SEQ ID NO: 75108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttaaaaactaatcttagac

SEQ ID NO: 75109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggttaaaaactaatctt

SEQ ID NO: 75110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattggttaaaaactaatct

SEQ ID NO: 75111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatgcttcattggttaaaa

SEQ ID NO: 75112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaatgcttcattggttaaa

SEQ ID NO: 75113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaatgcttcattggttaa

SEQ ID NO: 75114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttttgtaatgcttcattg

SEQ ID NO: 75115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtctgtgttttgtaatgctt

SEQ ID NO: 75116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtctgtgttttgtaatgct

SEQ ID NO: 75117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttagtctgtgttttgta

SEQ ID NO: 75118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttagtctgtgttttgt

SEQ ID NO: 75119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttgtatttagtctgtgt

SEQ ID NO: 75120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttgtatttagtctgtg

SEQ ID NO: 75121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatttgtatttagtctgt

SEQ ID NO: 75122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatatttgtatttagtctg

SEQ ID NO: 75123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagaataacttttatatttg

SEQ ID NO: 75124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acactatagaataactttta

SEQ ID NO: 75125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagaaataaagagaccattc

SEQ ID NO: 75126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaaccattgtagaaataaa

SEQ ID NO: 75127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgagaaccattgtagaaat

SEQ ID NO: 75128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaagcaaaatgttcctgag

SEQ ID NO: 75129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaagcaaaatgttcctga

SEQ ID NO: 75130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagaagcaaaatgttcctg

SEQ ID NO: 75131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttcagaagcaaaatgtt

SEQ ID NO: 75132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataaactaattttcagaagc

SEQ ID NO: 75133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taataaactaattttcagaa

SEQ ID NO: 75134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaataaactaattttcag

SEQ ID NO: 75135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaatatattctctaataaa

SEQ ID NO: 75136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaattgtcaatatattctc

SEQ ID NO: 75137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaattgtcaatatattct

SEQ ID NO: 75138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtttcagaattgtcaata

SEQ ID NO: 75139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagtttcagaattgtcaat

SEQ ID NO: 75140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagaccttatagtttcaga

SEQ ID NO: 75141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagaccttatagtttcag

SEQ ID NO: 75142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaagaccttatagtttca

SEQ ID NO: 75143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaagaccttatagtttc

SEQ ID NO: 75144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatcatttttgaaagacctt

SEQ ID NO: 75145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggttcaatcatttttgaaag

SEQ ID NO: 75146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggttcaatcatttttgaaa

SEQ ID NO: 75147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttgggttcaatcatttt

SEQ ID NO: 75148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatttgggttcaatcattt

SEQ ID NO: 75149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggaaagatgtacacaggtt

SEQ ID NO: 75150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggaaagatgtacacaggt

SEQ ID NO: 75151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcatttatggaaagatgta

SEQ ID NO: 75152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtatcgctaggcatttatgg

SEQ ID NO: 75153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtaaaaacctagtatcgct

SEQ ID NO: 75154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtaaaaacctagtatcgc

SEQ ID NO: 75155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggtaaaaacctagtatcg

SEQ ID NO: 75156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtatgattttaggtaaaaac

SEQ ID NO: 75157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggtatgattttaggtaa

SEQ ID NO: 75158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattggtatgattttaggta

SEQ ID NO: 75159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gggagaggatagtgagtgat

SEQ ID NO: 75160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggtaagagaactcgggaga

SEQ ID NO: 75161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggtaagagaactcgggag

SEQ ID NO: 75162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagggtaagagaactcggga

SEQ ID NO: 75163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttagggtaagagaactcg

SEQ ID NO: 75164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttagggtaagagaactc

SEQ ID NO: 75165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagaaaaatgtcttatttta

SEQ ID NO: 75166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgtgtatcacccgaggca

SEQ ID NO: 75167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaatgtgtatcacccgag

SEQ ID NO: 75168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccccaatcaggtaccaccc

SEQ ID NO: 75169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctacccccaatcaggtacc

SEQ ID NO: 75170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtcgaagggcataggcga

SEQ ID NO: 75171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtgtcgaagggcataggcg

SEQ ID NO: 75172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caccttggtgtcgaagggca

SEQ ID NO: 75173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaccttggtgtcgaagggc

SEQ ID NO: 75174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcgaaatcagaatcagagga

SEQ ID NO: 75175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaaattgtcgaaatcagaa

SEQ ID NO: 75176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagtggagaggaaaagggag

SEQ ID NO: 75177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccagtggagaggaaaaggg

SEQ ID NO: 75178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagaaagaagaaacagaaga

SEQ ID NO: 75179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagtgctaaagaaagaaga

SEQ ID NO: 75180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaaagtgctaaagaaagaa

SEQ ID NO: 75181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agctctaaaagtgctaaaga

SEQ ID NO: 75182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaacatccaaactgagctct

SEQ ID NO: 75183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaacatccaaactgagct

SEQ ID NO: 75184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgaaacatccaaactgagc

SEQ ID NO: 75185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctgaaacatccaaactga

SEQ ID NO: 75186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagagttcttctgaaacat

SEQ ID NO: 75187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcagagagttcttctgaaac

SEQ ID NO: 75188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgggcctctcagagagttct

SEQ ID NO: 75189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagaagcagaattatgggc

SEQ ID NO: 75190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatatacaagtattaggaga

SEQ ID NO: 75191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagcggcagcggctgaatat

SEQ ID NO: 75192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcccaaccaggcaattgcag

SEQ ID NO: 75193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcccaaccaggcaattgca

SEQ ID NO: 75194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acgtcttggcccaaccaggc

SEQ ID NO: 75195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgttaacgtcttggccca

SEQ ID NO: 75196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtgttaacgtcttggccc

SEQ ID NO: 75197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttaagtgttaacgtcttg

SEQ ID NO: 75198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaatgactcatttaagtgt

SEQ ID NO: 75199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaatgactcatttaagtg

SEQ ID NO: 75200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggatttggaaatgactcatt

SEQ ID NO: 75201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaggatttggaaatgactc

SEQ ID NO: 75202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctaggatttggaaatgact

SEQ ID NO: 75203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggtttcctaggatttggaa

SEQ ID NO: 75204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcctagggtttcctaggatt

SEQ ID NO: 75205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataggtgaaagatgtcctgt

SEQ ID NO: 75206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgctaataggtgaaagatgt

SEQ ID NO: 75207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatgctaataggtgaaaga

SEQ ID NO: 75208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgcaccatgttgttatgc

SEQ ID NO: 75209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggacatgattatatgcac

SEQ ID NO: 75210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaggacatgattatatgca

SEQ ID NO: 75211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtttaaaggacatgatta

SEQ ID NO: 75212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgtttaaaggacatgatt

SEQ ID NO: 75213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtaaagaaaacgatcattt

SEQ ID NO: 75214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcattgtgtaaagaaaacg

SEQ ID NO: 75215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatcattgtgtaaagaaaa

SEQ ID NO: 75216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagcattctgatcattgtg

SEQ ID NO: 75217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaagcattctgatcattgt

SEQ ID NO: 75218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtaagcattctgatcattg

SEQ ID NO: 75219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agacaaaaaccaaatatata

SEQ ID NO: 75220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacctgagacaaaaaccaaa

SEQ ID NO: 75221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacctgagacaaaaaccaa

SEQ ID NO: 75222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcaacctgagacaaaaac

SEQ ID NO: 75223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcaacctgagacaaaaa

SEQ ID NO: 75224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttcaacctgagacaaaa

SEQ ID NO: 75225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatacaatagagctttatt

SEQ ID NO: 75226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaatacaatagagcttta

SEQ ID NO: 75227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attctaaaatacaatagagc

SEQ ID NO: 75228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattctaaaatacaatagag

SEQ ID NO: 75229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataacatgtaatagtttaat

SEQ ID NO: 75230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taagcaaattaataacatgt

SEQ ID NO: 75231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtaagcaaattaataaca

SEQ ID NO: 75232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgtaagcaaattaataac

SEQ ID NO: 75233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactgtaagcaaattaataa

SEQ ID NO: 75234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctttactgtaagcaaatta

SEQ ID NO: 75235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctttactgtaagcaaatt

SEQ ID NO: 75236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttgtctttactgtaagca

SEQ ID NO: 75237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttgtctttactgtaagc

SEQ ID NO: 75238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatataatatttaatttgt

SEQ ID NO: 75239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacatataatatttaatttg

SEQ ID NO: 75240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taacatataatatttaattt

SEQ ID NO: 75241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaaactttaacatataata

SEQ ID NO: 75242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaaaactttaacatataat

SEQ ID NO: 75243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttgtaaaactttaacata

SEQ ID NO: 75244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaattaccttgtaaaact

SEQ ID NO: 75245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattccaaaattaccttgta

SEQ ID NO: 75246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattccaaaattaccttgt

SEQ ID NO: 75247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacattccaaaattaccttg

SEQ ID NO: 75248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcgagttttacattccaaa

SEQ ID NO: 75249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgcgagttttacattccaa

SEQ ID NO: 75250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catggtttatgcgagtttta

SEQ ID NO: 75251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcatggtttatgcgagtt

SEQ ID NO: 75252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgcatggtttatgcgagt

SEQ ID NO: 75253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttattgcatggtttatgc

SEQ ID NO: 75254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgtcttattgcatggttt

SEQ ID NO: 75255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataatcaaattgtctgtctt

SEQ ID NO: 75256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctgataatcaaattgtctg

SEQ ID NO: 75257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgcctgataatcaaattg

SEQ ID NO: 75258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgatatggagttaattgcc

SEQ ID NO: 75259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgatgatatggagttaatt

SEQ ID NO: 75260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattgatgatatggagttaa

SEQ ID NO: 75261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attctattgatgatatggag

SEQ ID NO: 75262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaccatagagtgcctgattc

SEQ ID NO: 75263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaaccatagagtgcctga

SEQ ID NO: 75264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaaaccatagagtgcctg

SEQ ID NO: 75265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattaaaccatagagtgcct

SEQ ID NO: 75266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatctttattaaaccataga

SEQ ID NO: 75267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaataactcaatctttatta

SEQ ID NO: 75268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaataactcaatctttatt

SEQ ID NO: 75269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaataactcaatctttat

SEQ ID NO: 75270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaaataactcaatcttta

SEQ ID NO: 75271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttcaaataactcaatct

SEQ ID NO: 75272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttcaaataactcaatc

SEQ ID NO: 75273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttatttttcaaataactc

SEQ ID NO: 75274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataattcatttatttttcaa

SEQ ID NO: 75275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataattcatttatttttca

SEQ ID NO: 75276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taataattcatttatttttc

SEQ ID NO: 75277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgctttaataattcatttat

SEQ ID NO: 75278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatattatgctttaataat

SEQ ID NO: 75279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaatattatgctttaataa

SEQ ID NO: 75280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacaatattatgctttaat

SEQ ID NO: 75281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttacaatattatgctttaa

SEQ ID NO: 75282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttacaatattatgcttta

SEQ ID NO: 75283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccactttcttacaatattat

SEQ ID NO: 75284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accactttcttacaatatta

SEQ ID NO: 75285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accttaccactttcttacaa

SEQ ID NO: 75286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggccaatagtcattgacctt

SEQ ID NO: 75287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggccaatagtcattgacct

SEQ ID NO: 75288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttaggccaatagtcattg

SEQ ID NO: 75289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttaggccaatagtcatt

SEQ ID NO: 75290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagaagtttcatttaggcc

SEQ ID NO: 75291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggaattcccagaagtttca

SEQ ID NO: 75292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctagggaattcccagaagt

SEQ ID NO: 75293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcccaggtactacctaggga

SEQ ID NO: 75294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggttatcccaggtactacct

SEQ ID NO: 75295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaagggatagtactaggtt

SEQ ID NO: 75296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaagggatagtactaggt

SEQ ID NO: 75297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaaagggatagtactagg

SEQ ID NO: 75298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaacaaaacattttgtaaa

SEQ ID NO: 75299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaacaaaacattttgtaa

SEQ ID NO: 75300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtttataaacaaaacatt

SEQ ID NO: 75301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgtttataaacaaaacat

SEQ ID NO: 75302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgtttataaacaaaaca

SEQ ID NO: 75303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtgtttataaacaaaac

SEQ ID NO: 75304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttagtgtttataaacaaaa

SEQ ID NO: 75305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagaattttttagtgttta

SEQ ID NO: 75306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaagaattttttagtgttt

SEQ ID NO: 75307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaagaattttttagtgtt

SEQ ID NO: 75308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacaagaattttttagtgt

SEQ ID NO: 75309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccatgtttttacaagaattt

SEQ ID NO: 75310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccatgtttttacaagaatt

SEQ ID NO: 75311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcccatgtttttacaaga

SEQ ID NO: 75312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcccatgtttttacaag

SEQ ID NO: 75313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttcccatgtttttacaa

SEQ ID NO: 75314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatctttatttcccatgttt

SEQ ID NO: 75315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatctttatttcccatgtt

SEQ ID NO: 75316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttatatctttatttccca

SEQ ID NO: 75317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttatatctttatttccc

SEQ ID NO: 75318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatttatatctttatttcc

SEQ ID NO: 75319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatttatatctttatttc

SEQ ID NO: 75320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttcatttatatctttat

SEQ ID NO: 75321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttttcatttatatcttt

SEQ ID NO: 75322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtttttcatttatatctt

SEQ ID NO: 75323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtttttcatttatatct

SEQ ID NO: 75324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgtttttcatttatatc

SEQ ID NO: 75325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctgtttttcatttatat

SEQ ID NO: 75326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctgtttttcatttata

SEQ ID NO: 75327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttctgtttttcatttat

SEQ ID NO: 75328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaggtaagatgactttttt

SEQ ID NO: 75329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggaggtaagatgactttt

SEQ ID NO: 75330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgggaggtaagatgacttt

SEQ ID NO: 75331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctgggaggtaagatgac

SEQ ID NO: 75332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaccaattatttctgggag

SEQ ID NO: 75333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacatacatataaaaagaat

SEQ ID NO: 75334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattatacatacatataaa

SEQ ID NO: 75335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaattatacatacatataa

SEQ ID NO: 75336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaattatacatacatata

SEQ ID NO: 75337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aattttaaaattatacatac

SEQ ID NO: 75338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataatatagtccgatacaa

SEQ ID NO: 75339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaataatgatggattaaata

SEQ ID NO: 75340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaataatgatggattaaat

SEQ ID NO: 75341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaataatgatggattaaa

SEQ ID NO: 75342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagaataatgatggattaa

SEQ ID NO: 75343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatgaggaaaaatctttta

SEQ ID NO: 75344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcatgaggaaaaatctttt

SEQ ID NO: 75345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcatgaggaaaaatcttt

SEQ ID NO: 75346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttatcatgaggaaaaatc

SEQ ID NO: 75347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattattttatcatgagga

SEQ ID NO: 75348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaattattttatcatgagg

SEQ ID NO: 75349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaattattttatcatgag

SEQ ID NO: 75350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaattattttatcatga

SEQ ID NO: 75351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaattattttatcatg

SEQ ID NO: 75352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaaattattttatcat

SEQ ID NO: 75353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgtttttttaaaattatt

SEQ ID NO: 75354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatagaactatgtgttttt

SEQ ID NO: 75355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccatagaactatgtgtttt

SEQ ID NO: 75356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgccatagaactatgtgttt

SEQ ID NO: 75357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgccatagaactatgtg

SEQ ID NO: 75358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtattattttgccataga

SEQ ID NO: 75359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagtattattttgccatag

SEQ ID NO: 75360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatatcttaaagtattattt

SEQ ID NO: 75361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaaaattgtatatcttaaa

SEQ ID NO: 75362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaaaattatgaaaattgta

SEQ ID NO: 75363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaataactaagaaaatta

SEQ ID NO: 75364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaattagaaaataactaa

SEQ ID NO: 75365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaaattagaaaataacta

SEQ ID NO: 75366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaaaattagaaaataact

SEQ ID NO: 75367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattttggaaaattagaaaa

SEQ ID NO: 75368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattttggaaaattagaaa

SEQ ID NO: 75369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatggtaaaaatcagaaa

SEQ ID NO: 75370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataatggtaaaaatcagaa

SEQ ID NO: 75371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taataatggtaaaaatcaga

SEQ ID NO: 75372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgcagcattttaataatg

SEQ ID NO: 75373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgcacaaatattcagtgca

SEQ ID NO: 75374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatgcacaaatattcagtg

SEQ ID NO: 75375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caatgcagataaattctgat

SEQ ID NO: 75376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggggagggcaatcatctgca

SEQ ID NO: 75377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgtattaggggagggcaat

SEQ ID NO: 75378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggagtctaatgtattagg

SEQ ID NO: 75379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaggagtctaatgtattag

SEQ ID NO: 75380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcaaggagtctaatgtatt

SEQ ID NO: 75381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatctcttcaaggagtctaa

SEQ ID NO: 75382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttaaatctcttcaaggagt

SEQ ID NO: 75383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctagttaaatctcttcaa

SEQ ID NO: 75384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacctagttaaatctcttca

SEQ ID NO: 75385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaggtttcacctagttaaat

SEQ ID NO: 75386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgaaggtttcacctagtt

SEQ ID NO: 75387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctgaaggtttcacctagt

SEQ ID NO: 75388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatttgtctgaaggtttca

SEQ ID NO: 75389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacatttgtctgaaggtttc

SEQ ID NO: 75390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccttaacatttgtctgaagg

SEQ ID NO: 75391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagttgccttaacatttgtc

SEQ ID NO: 75392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatgtactgcagttgcctt

SEQ ID NO: 75393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatgtactgcagttgcct

SEQ ID NO: 75394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agagaaacataatttcaaat

SEQ ID NO: 75395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactaagagaaacataattt

SEQ ID NO: 75396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtactaagagaaacataatt

SEQ ID NO: 75397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaggcttgtactaagaga

SEQ ID NO: 75398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaaggcttgtactaagag

SEQ ID NO: 75399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgtaaatgtttgagaagg

SEQ ID NO: 75400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtgtaaatgtttgagaag

SEQ ID NO: 75401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcagtgtaaatgtttgaga

SEQ ID NO: 75402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagagagattcttcagtgta

SEQ ID NO: 75403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagagagattcttcagtgt

SEQ ID NO: 75404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccagagagattcttcagtg

SEQ ID NO: 75405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttccagagagattcttcag

SEQ ID NO: 75406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcctctttccagagagatt

SEQ ID NO: 75407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatcctctttccagagagat

SEQ ID NO: 75408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttaatcctctttccagaga

SEQ ID NO: 75409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctccttaatcctctttccag

SEQ ID NO: 75410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctccttaatcctctttcca

SEQ ID NO: 75411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gaaagtttcctccttaatcc

SEQ ID NO: 75412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcgaaagtttcctccttaat

SEQ ID NO: 75413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatagattctcgaaagttt

SEQ ID NO: 75414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggttgtcatagattctcgaa

SEQ ID NO: 75415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggttgtcatagattctcga

SEQ ID NO: 75416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttaggttgtcatagattc

SEQ ID NO: 75417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtggctaatttaggttgt

SEQ ID NO: 75418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgtggctaatttaggttg

SEQ ID NO: 75419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtgtggctaatttaggtt

SEQ ID NO: 75420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaaataattttggtgtgg

SEQ ID NO: 75421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agataaaacatgagatatta

SEQ ID NO: 75422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagataaaacatgagatatt

SEQ ID NO: 75423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagataaaacatgagatat

SEQ ID NO: 75424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagataaaacatgagata

SEQ ID NO: 75425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtcacaaggatttttaag

SEQ ID NO: 75426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaatgtcacaaggattttt

SEQ ID NO: 75427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaatgtcacaaggatttt

SEQ ID NO: 75428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttaatgtcacaaggattt

SEQ ID NO: 75429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaacagtgcatcatgttttg

SEQ ID NO: 75430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggggtatgactaaaacagt

SEQ ID NO: 75431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatggggtatgactaaaaca

SEQ ID NO: 75432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatggggtatgactaaaac

SEQ ID NO: 75433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctatggggtatgactaaa

SEQ ID NO: 75434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagatactcttctatgggg

SEQ ID NO: 75435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattaacagatactcttct

SEQ ID NO: 75436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acgttaaaattaacagatac

SEQ ID NO: 75437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacgttaaaattaacagata

SEQ ID NO: 75438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacgttaaaattaacagat

SEQ ID NO: 75439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaacgttaaaattaaca

SEQ ID NO: 75440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaaaattattttaacgtt

SEQ ID NO: 75441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgaaaattattttaacgt

SEQ ID NO: 75442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatacagtggtttcatgaaa

SEQ ID NO: 75443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccagagtaccaattgtata

SEQ ID NO: 75444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccagagtaccaattgtat

SEQ ID NO: 75445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatatatacaatatatat

SEQ ID NO: 75446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatatatatacaatatata

SEQ ID NO: 75447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatttatatatatatacaat

SEQ ID NO: 75448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataatatagtcagatatat

SEQ ID NO: 75449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attaaataatatagtcagat

SEQ ID NO: 75450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaataattgattaaataata

SEQ ID NO: 75451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaataattgattaaataat

SEQ ID NO: 75452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaataattgattaaataa

SEQ ID NO: 75453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagaataattgattaaata

SEQ ID NO: 75454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcatgaggaaaaatcttt

SEQ ID NO: 75455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatatcatgaggaaaaatc

SEQ ID NO: 75456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattattatatcatgaggaa

SEQ ID NO: 75457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattattatatcatgagga

SEQ ID NO: 75458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaattattatatcatgagg

SEQ ID NO: 75459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaattattatatcatgag

SEQ ID NO: 75460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaattattatatcatga

SEQ ID NO: 75461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaattattatatcatg

SEQ ID NO: 75462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgtttttttaaattatta

SEQ ID NO: 75463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatacatacacatataca

SEQ ID NO: 75464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtgtgtgtgtgtatgtct

SEQ ID NO: 75465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtgtgtgtgtgtgtatgtc

SEQ ID NO: 75466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caatgacttagtgtgtgtgt

SEQ ID NO: 75467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctacaatgacttagtgtgt

SEQ ID NO: 75468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctacaatgacttagtgtg

SEQ ID NO: 75469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacctacaatgacttagtgt

SEQ ID NO: 75470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttacctacaatgacttagtg

SEQ ID NO: 75471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaccttttacctacaatgac

SEQ ID NO: 75472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaccttttacctacaatga

SEQ ID NO: 75473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaaaccttttacctacaat

SEQ ID NO: 75474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcttaaaccttttacctac

SEQ ID NO: 75475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcctcttaaaccttttacc

SEQ ID NO: 75476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggctgttcctcttaaacct

SEQ ID NO: 75477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catgaaaagtgatctaaggc

SEQ ID NO: 75478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgcatgaaaagtgatcta

SEQ ID NO: 75479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccataatcatctcactgca

SEQ ID NO: 75480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccataatcatctcactgc

SEQ ID NO: 75481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccccataatcatctcactg

SEQ ID NO: 75482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atactttccccataatcatc

SEQ ID NO: 75483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaattgatactttccccata

SEQ ID NO: 75484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agctagaattgatactttcc

SEQ ID NO: 75485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggctgagctagaattgatac

SEQ ID NO: 75486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggctgagctagaattgat

SEQ ID NO: 75487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgtggaaaaaggaaccaat

SEQ ID NO: 75488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggtgtggaaaaaggaacca

SEQ ID NO: 75489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggtgtggaaaaaggaacc

SEQ ID NO: 75490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttctggtgtggaaaaagg

SEQ ID NO: 75491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatcctcatttctggtgtgg

SEQ ID NO: 75492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtataaactgtatcctcat

SEQ ID NO: 75493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtataaactgtatcctca

SEQ ID NO: 75494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtataaactgtatcctc

SEQ ID NO: 75495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgtataaactgtatcct

SEQ ID NO: 75496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaatttttgtgtataaac

SEQ ID NO: 75497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgaatttttgtgtataaa

SEQ ID NO: 75498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatgaatttttgtgtataa

SEQ ID NO: 75499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaatgaatttttgtgtat

SEQ ID NO: 75500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttaatgaatttttgtgta

SEQ ID NO: 75501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttaatgaatttttgtgt

SEQ ID NO: 75502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gattttctttaatgaatttt

SEQ ID NO: 75503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagctagattttctttaatg

SEQ ID NO: 75504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccagctagattttctttaa

SEQ ID NO: 75505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctccagctagattttcttta

SEQ ID NO: 75506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccttctccagctagatttt

SEQ ID NO: 75507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggccttctccagctagattt

SEQ ID NO: 75508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cggtatatgcttggccttct

SEQ ID NO: 75509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcggtatatgcttggcctt

SEQ ID NO: 75510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caacagaggctctgcggtat

SEQ ID NO: 75511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaggtagaaatgcaaacggt

SEQ ID NO: 75512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctagaggtagaaatgcaaac

SEQ ID NO: 75513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctagaggtagaaatgcaaa

SEQ ID NO: 75514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcctagaggtagaaatgca

SEQ ID NO: 75515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattcttcctagaggtaga

SEQ ID NO: 75516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaattcttcctagaggtag

SEQ ID NO: 75517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttaaaattcttcctagag

SEQ ID NO: 75518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttaaaattcttcctaga

SEQ ID NO: 75519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgatttaaaattcttcct

SEQ ID NO: 75520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatttgatttaaaattctt

SEQ ID NO: 75521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtactgttatttgattta

SEQ ID NO: 75522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaagagcaagaagaagct

SEQ ID NO: 75523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaaaagagcaagaagaagc

SEQ ID NO: 75524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaccgtcttaaaaaagagca

SEQ ID NO: 75525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacagatgttagaccgtctt

SEQ ID NO: 75526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacagatgttagaccgtct

SEQ ID NO: 75527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatttcaacagatgttaga

SEQ ID NO: 75528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacagaaagaattagaattt

SEQ ID NO: 75529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaagctaaacagaaagaa

SEQ ID NO: 75530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatggcatatgaagaacag

SEQ ID NO: 75531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggttgccatggcatatgaa

SEQ ID NO: 75532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctgtggttgccatggcata

SEQ ID NO: 75533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcctggctgtggttgccat

SEQ ID NO: 75534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatcctggctgtggttgcca

SEQ ID NO: 75535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataaacttgatcctggctgt

SEQ ID NO: 75536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctaataaacttgatcctgg

SEQ ID NO: 75537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctaataaacttgatcctg

SEQ ID NO: 75538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatctaataaacttgatcct

SEQ ID NO: 75539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatctaataaacttgatcc

SEQ ID NO: 75540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttttatctaataaacttga

SEQ ID NO: 75541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggctccttttatctaataaa

SEQ ID NO: 75542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgggctccttttatctaat

SEQ ID NO: 75543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgggctccttttatctaa

SEQ ID NO: 75544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgggctccttttatcta

SEQ ID NO: 75545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcgtagtgattttcctgggc

SEQ ID NO: 75546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcgtagtgattttcctggg

SEQ ID NO: 75547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtcgtagtgattttcctgg

SEQ ID NO: 75548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgtcgtagtgattttcct

SEQ ID NO: 75549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttgtcgtagtgattttcc

SEQ ID NO: 75550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgatcttctttgtcgtag

SEQ ID NO: 75551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaaaacctacatgatcttc

SEQ ID NO: 75552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctggcaaaacctacatgatc

SEQ ID NO: 75553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgtgctgctggcaaaaccta

SEQ ID NO: 75554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gacgctgcgtgctgctggca

SEQ ID NO: 75555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctagacgctgcgtgctgct

SEQ ID NO: 75556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctagacgctgcgtgctgc

SEQ ID NO: 75557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccctagacgctgcgtgctg

SEQ ID NO: 75558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccctagacgctgcgtgct

SEQ ID NO: 75559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttttccctagacgctgc

SEQ ID NO: 75560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatttttccctagacgctg

SEQ ID NO: 75561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatgacaatttccattttt

SEQ ID NO: 75562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcaaatgacaatttccatt

SEQ ID NO: 75563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgttcaaatgacaatttcc

SEQ ID NO: 75564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgttcaaatgacaatttc

SEQ ID NO: 75565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgttcaaatgacaattt

SEQ ID NO: 75566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattgttcaaatgacaatt

SEQ ID NO: 75567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttattgttcaaatgacaat

SEQ ID NO: 75568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaaaactttttattgttca

SEQ ID NO: 75569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaaaaaaactttttattgt

SEQ ID NO: 75570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actaaaaaaactttttattg

SEQ ID NO: 75571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaataatttactaaaaaaac

SEQ ID NO: 75572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcaaattgaaataatttact

SEQ ID NO: 75573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgcctgtcaaattgaaata

SEQ ID NO: 75574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcatgcctgtcaaattgaa

SEQ ID NO: 75575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctcatgcctgtcaaattga

SEQ ID NO: 75576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcagatttgctcatgcctgt

SEQ ID NO: 75577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taccaaactgtcagatttgc

SEQ ID NO: 75578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataacatgagattataccaa

SEQ ID NO: 75579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gataacatgagattatacca

SEQ ID NO: 75580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgataacatgagattatacc

SEQ ID NO: 75581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgataacatgagattatac

SEQ ID NO: 75582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttttgataacatgagat

SEQ ID NO: 75583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttttgataacatgaga

SEQ ID NO: 75584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatatttttgataacatgag

SEQ ID NO: 75585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttatatttttgataacatg

SEQ ID NO: 75586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttatatttttgataaca

SEQ ID NO: 75587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctttatatttttgataac

SEQ ID NO: 75588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctttatatttttgataa

SEQ ID NO: 75589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctctttatatttttgata

SEQ ID NO: 75590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgaagatataacttttct

SEQ ID NO: 75591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatgaagatataacttttc

SEQ ID NO: 75592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatgaagatataactttt

SEQ ID NO: 75593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttccatgaagatataact

SEQ ID NO: 75594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttccatgaagatataac

SEQ ID NO: 75595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatttgttttccatgaaga

SEQ ID NO: 75596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatatttgttttccatgaag

SEQ ID NO: 75597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaatgtgtttaatatttgt

SEQ ID NO: 75598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtactgaaaatgtgtttaat

SEQ ID NO: 75599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgtactgaaaatgtgtttaa

SEQ ID NO: 75600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcgtactgaaaatgtgttt

SEQ ID NO: 75601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattcttcgtactgaaaatg

SEQ ID NO: 75602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctatattcttcgtactgaaa

SEQ ID NO: 75603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattgctatattcttcgtac

SEQ ID NO: 75604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtacaagcatattacattgc

SEQ ID NO: 75605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtacaagcatattacattg

SEQ ID NO: 75606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtacaagcatattacatt

SEQ ID NO: 75607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgactttagtacaagcat

SEQ ID NO: 75608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatgactttagtacaagca

SEQ ID NO: 75609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatcaagaatcttacatg

SEQ ID NO: 75610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aataatcaagaatcttacat

SEQ ID NO: 75611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacttaataatcaagaatct

SEQ ID NO: 75612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctacacttaataatcaagaa

SEQ ID NO: 75613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactactacacttaataatc

SEQ ID NO: 75614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atactactacacttaataat

SEQ ID NO: 75615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatactactacacttaataa

SEQ ID NO: 75616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatactactacacttaata

SEQ ID NO: 75617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taggaaaaaatgcatgattt

SEQ ID NO: 75618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agactgtaggaaaaaatgca

SEQ ID NO: 75619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagactgtaggaaaaaatgc

SEQ ID NO: 75620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagactgtaggaaaaaatg

SEQ ID NO: 75621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagtaattttcagactgta

SEQ ID NO: 75622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgagtaattttcagactgt

SEQ ID NO: 75623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgagtaattttcagactg

SEQ ID NO: 75624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttatgagtaattttcag

SEQ ID NO: 75625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttatgagtaattttca

SEQ ID NO: 75626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagtgagcaaaggatttaa

SEQ ID NO: 75627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagtgagcaaaggattta

SEQ ID NO: 75628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatttgaaagtgagcaaag

SEQ ID NO: 75629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaaaatttgaaagtgagca

SEQ ID NO: 75630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcctaaaatttgaaagtga

SEQ ID NO: 75631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggatatcacctgttcctaa

SEQ ID NO: 75632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagtaaaagggactatgga

SEQ ID NO: 75633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacagtaaaagggactatgg

SEQ ID NO: 75634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacagtaaaagggactatg

SEQ ID NO: 75635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgataaagaaagaaaagat

SEQ ID NO: 75636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgataaagaaagaaaaga

SEQ ID NO: 75637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatttgatgataaagaaag

SEQ ID NO: 75638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaatatttgatgataaaga

SEQ ID NO: 75639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgatattattaatatttg

SEQ ID NO: 75640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acattcaatgatattattaa

SEQ ID NO: 75641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgttaacattcaatgatat

SEQ ID NO: 75642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctagtgttaacattcaatg

SEQ ID NO: 75643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataagaccatctgcctagt

SEQ ID NO: 75644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgagatgaataaagtaatta

SEQ ID NO: 75645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaatacctatgagatgaat

SEQ ID NO: 75646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgaaaatacctatgagat

SEQ ID NO: 75647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagcaaagaaagcgaaaa

SEQ ID NO: 75648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaagcaaagaaagcgaaa

SEQ ID NO: 75649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaagcaaagaaagcgaa

SEQ ID NO: 75650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttaaaaagcaaagaaagc

SEQ ID NO: 75651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattttaaaaagcaaagaaa

SEQ ID NO: 75652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaaaaattctattttaaa

SEQ ID NO: 75653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaaaaaattctattttaa

SEQ ID NO: 75654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaaaaaaattctatttta

SEQ ID NO: 75655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttgaaaaaaaattctatt

SEQ ID NO: 75656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaactattttgaaaaaaaat

SEQ ID NO: 75657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcctaaaactattttgaaa

SEQ ID NO: 75658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatcctaaaactattttga

SEQ ID NO: 75659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctaatcctaaaactattt

SEQ ID NO: 75660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctctaatcctaaaactatt

SEQ ID NO: 75661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctctaatcctaaaactat

SEQ ID NO: 75662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttcctctaatcctaaaa

SEQ ID NO: 75663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttcctctaatcctaaa

SEQ ID NO: 75664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtttaattttcctctaatc

SEQ ID NO: 75665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtttaattttcctctaat

SEQ ID NO: 75666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taccttcagtttaattttcc

SEQ ID NO: 75667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtaccttcagtttaatttt

SEQ ID NO: 75668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgccaaaaaaaagaaaaaaa

SEQ ID NO: 75669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacgttatgccaaaaaaaag

SEQ ID NO: 75670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccatgtaacaaacctgcac

SEQ ID NO: 75671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgggtgcagcaaaccacca

SEQ ID NO: 75672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgtaggtaacaggttgatg

SEQ ID NO: 75673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagacatacctaatgtagg

SEQ ID NO: 75674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcggtggtggggggcaaagg

SEQ ID NO: 75675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggcctgtcggtggtggggg

SEQ ID NO: 75676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgagtgagaggtgggcaat

SEQ ID NO: 75677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actcatgagtgagaggtggg

SEQ ID NO: 75678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcactcatgagtgagaggtg

SEQ ID NO: 75679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaacaggaacagaaaaccaa

SEQ ID NO: 75680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcaaactaaaacaggaaca

SEQ ID NO: 75681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagcaaactaaaacaggaa

SEQ ID NO: 75682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaaccatcattctcagcaa

SEQ ID NO: 75683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagggacatggatgaagcta

SEQ ID NO: 75684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagggacatggatgaagct

SEQ ID NO: 75685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcagggacatggatgaagc

SEQ ID NO: 75686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtcctttgcagggacatg

SEQ ID NO: 75687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcagccataaaaaagaata

SEQ ID NO: 75688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gataaagaaaatgtggcaca

SEQ ID NO: 75689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaaccaacccaaatgccca

SEQ ID NO: 75690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaatagcaaagactgggaa

SEQ ID NO: 75691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcacaatagcaaagactgg

SEQ ID NO: 75692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggcactattcacaatagca

SEQ ID NO: 75693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtggcactattcacaata

SEQ ID NO: 75694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgtggcactattcacaat

SEQ ID NO: 75695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggtaaagacacatgcacac

SEQ ID NO: 75696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatggtaaagacacatgcac

SEQ ID NO: 75697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catatcattctatggtaaag

SEQ ID NO: 75698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtatatacccaaaagatta

SEQ ID NO: 75699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgggtatatacccaaaaga

SEQ ID NO: 75700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaccagtgtggaagacagtg

SEQ ID NO: 75701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttcaaccagtgtggaagac

SEQ ID NO: 75702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaggagtgtaaattagttc

SEQ ID NO: 75703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttggtaggagtgtaaattag

SEQ ID NO: 75704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactgttggtaggagtgtaa

SEQ ID NO: 75705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaactgttggtaggagtgta

SEQ ID NO: 75706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaactgttggtaggagtgt

SEQ ID NO: 75707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaactgttggtaggagtg

SEQ ID NO: 75708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagaaaatgtggagaaatag

SEQ ID NO: 75709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagtcagaaaataacaga

SEQ ID NO: 75710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatggtgataattaaaaag

SEQ ID NO: 75711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgccagttagaatggtgat

SEQ ID NO: 75712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaccacaatgagatacca

SEQ ID NO: 75713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagaaatgcaattcaaaacc

SEQ ID NO: 75714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccattagagaaatgcaatt

SEQ ID NO: 75715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcatcactggccattagag

SEQ ID NO: 75716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacatatgaaaaaaagctca

SEQ ID NO: 75717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaacatatgaaaaaaagctc

SEQ ID NO: 75718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatgtatcccataacttaa

SEQ ID NO: 75719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacatgtatcccataactta

SEQ ID NO: 75720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcacatgtatcccataact

SEQ ID NO: 75721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catgttcttcacatgtatcc

SEQ ID NO: 75722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtaaccaacctgcatgttc

SEQ ID NO: 75723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataggtggagcaaaccacca

SEQ ID NO: 75724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gataatgggttgataggtgg

SEQ ID NO: 75725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacctagataatgggttga

SEQ ID NO: 75726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaacctagataatgggttg

SEQ ID NO: 75727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgcatgcaggtcttaaaac

SEQ ID NO: 75728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctaatgcatgcaggtctta

SEQ ID NO: 75729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggacaactacctaatgcatg

SEQ ID NO: 75730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggggtgggaggcaagggga

SEQ ID NO: 75731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttggggggtgggaggcaagg

SEQ ID NO: 75732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacacatggacacagggagg

SEQ ID NO: 75733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaacacatggacacagggag

SEQ ID NO: 75734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacaatttgaacacatggac

SEQ ID NO: 75735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataagtgggagttgaacaat

SEQ ID NO: 75736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actcataagtgggagttgaa

SEQ ID NO: 75737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcactcataagtgggagttg

SEQ ID NO: 75738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catgttctcactcataagtg

SEQ ID NO: 75739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atacaggaagagaaaaccaa

SEQ ID NO: 75740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcaaactaatacaggaaga

SEQ ID NO: 75741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagccatcatcctcagcaa

SEQ ID NO: 75742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagggacatggatgaagctg

SEQ ID NO: 75743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagggacatggatgaagct

SEQ ID NO: 75744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacagggacatggatgaagc

SEQ ID NO: 75745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaagaatgagatcatgtc

SEQ ID NO: 75746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcagccattaaaaaagaat

SEQ ID NO: 75747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataaagaaaatgtggtaca

SEQ ID NO: 75748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgtataaagaaaatgtg

SEQ ID NO: 75749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatgcccatcaatgttaaa

SEQ ID NO: 75750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatagcaaagagatggaat

SEQ ID NO: 75751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaatagcaaagagatggaa

SEQ ID NO: 75752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttacaatagcaaagagatg

SEQ ID NO: 75753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtactatttacaatagca

SEQ ID NO: 75754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcagtactatttacaata

SEQ ID NO: 75755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgcagtactatttacaat

SEQ ID NO: 75756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaagacacatgcacacata

SEQ ID NO: 75757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctacaaagacacatgcacac

SEQ ID NO: 75758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactacaaagacacatgcac

SEQ ID NO: 75759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtatataccgaaacgaata

SEQ ID NO: 75760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgggtatataccgaaacga

SEQ ID NO: 75761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcaatcccattactgggtat

SEQ ID NO: 75762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acctagcaatcccattactg

SEQ ID NO: 75763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacctagcaatcccattact

SEQ ID NO: 75764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaccagaaataccatttga

SEQ ID NO: 75765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggacctagaaccagaaata

SEQ ID NO: 75766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaggacctagaaccagaaat

SEQ ID NO: 75767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttaaggacctagaaccaga

SEQ ID NO: 75768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagacagtgaggcaattcct

SEQ ID NO: 75769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagacagtgaggcaattcc

SEQ ID NO: 75770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagacagtgaggcaattc

SEQ ID NO: 75771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacaattttgaagacagtga

SEQ ID NO: 75772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttcaacaattttgaagaca

SEQ ID NO: 75773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgggagtgtaaattagttc

SEQ ID NO: 75774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttggtgggagtgtaaattag

SEQ ID NO: 75775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactgttggtgggagtgtaa

SEQ ID NO: 75776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acactgttggtgggagtgta

SEQ ID NO: 75777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacactgttggtgggagtgt

SEQ ID NO: 75778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttacactgttggtgggagtg

SEQ ID NO: 75779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaagaaatagtagcacttt

SEQ ID NO: 75780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgaggctatgaagaaatag

SEQ ID NO: 75781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggtgaggctatgaagaaat

SEQ ID NO: 75782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaacaatagattctggtg

SEQ ID NO: 75783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagttgagaaacaataga

SEQ ID NO: 75784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaaaagttgagaaacaat

SEQ ID NO: 75785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagtcagtcagaatggtgat

SEQ ID NO: 75786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaacgcaaatcaaaacca

SEQ ID NO: 75787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacatcagtgatcattaaga

SEQ ID NO: 75788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcggccaaaaaacatgaaa

SEQ ID NO: 75789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgcggccaaaaaacatgaa

SEQ ID NO: 75790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaagaagacatttatgcgg

SEQ ID NO: 75791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaaagaagacatttatgc

SEQ ID NO: 75792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcaaaagaagacatttatg

SEQ ID NO: 75793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catcccatcaaaaagtgggc

SEQ ID NO: 75794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcatcccatcaaaaagtggg

SEQ ID NO: 75795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaccagccttgcatcccatc

SEQ ID NO: 75796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catatattgaaccagccttg

SEQ ID NO: 75797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatatattgaaccagcctt

SEQ ID NO: 75798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttgcatatattgaaccag

SEQ ID NO: 75799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgatttgcatatattgaac

SEQ ID NO: 75800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgatttgcatatattgaa

SEQ ID NO: 75801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttattgatttgcatata

SEQ ID NO: 75802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgatggattacatttatt

SEQ ID NO: 75803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtgatggattacatttat

SEQ ID NO: 75804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttatgtgatggattacatt

SEQ ID NO: 75805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttatgtgatggattaca

SEQ ID NO: 75806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttctgtttatgtgatggat

SEQ ID NO: 75807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcattggttctgtttatgtg

SEQ ID NO: 75808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcattggttctgtttatgt

SEQ ID NO: 75809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcattggttctgtttatg

SEQ ID NO: 75810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtcattggttctgtttat

SEQ ID NO: 75811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agataatcatgtggtttttg

SEQ ID NO: 75812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgagataatcatgtggttt

SEQ ID NO: 75813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catctattgagataatcatg

SEQ ID NO: 75814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcatctattgagataatca

SEQ ID NO: 75815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgcatctattgagataat

SEQ ID NO: 75816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctgcatctattgagataa

SEQ ID NO: 75817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaccttctctgcatctat

SEQ ID NO: 75818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaagaccttctctgcatc

SEQ ID NO: 75819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgaagaccttctctgcat

SEQ ID NO: 75820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgaagaccttctctgca

SEQ ID NO: 75821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattttattgaagaccttct

SEQ ID NO: 75822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatgaatggatgttgcatt

SEQ ID NO: 75823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacatgaatggatgttgcat

SEQ ID NO: 75824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacatgaatggatgttgca

SEQ ID NO: 75825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaacatgaatggatgttgc

SEQ ID NO: 75826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagtttttaacatgaatgg

SEQ ID NO: 75827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgatagtttttaacatgaa

SEQ ID NO: 75828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgatagtttttaacatga

SEQ ID NO: 75829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttattgatagtttttaac

SEQ ID NO: 75830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catcaatacctagtttattg

SEQ ID NO: 75831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatatgttccatcaatacc

SEQ ID NO: 75832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagatatgttccatcaatac

SEQ ID NO: 75833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagatatgttccatcaata

SEQ ID NO: 75834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgagatatgttccatca

SEQ ID NO: 75835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattttgagatatgttcca

SEQ ID NO: 75836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attattttgagatatgttcc

SEQ ID NO: 75837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttattattttgagatatgtt

SEQ ID NO: 75838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaatagctcttattattt

SEQ ID NO: 75839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cataaatagctcttattatt

SEQ ID NO: 75840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcataaatagctcttattat

SEQ ID NO: 75841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggagttttcataaatagct

SEQ ID NO: 75842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctatggagttttcataaat

SEQ ID NO: 75843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtatgatattggctatgga

SEQ ID NO: 75844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccattcagtatgatattggc

SEQ ID NO: 75845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccattcagtatgatattgg

SEQ ID NO: 75846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccattcagtatgatattg

SEQ ID NO: 75847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcccattcagtatgatatt

SEQ ID NO: 75848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcccattcagtatgatat

SEQ ID NO: 75849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagctttttcccattcagta

SEQ ID NO: 75850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccagctttttcccattcagt

SEQ ID NO: 75851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagggaatgcttccagcttt

SEQ ID NO: 75852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagggaatgcttccagctt

SEQ ID NO: 75853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagggaatgcttccagct

SEQ ID NO: 75854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaagggaatgcttccagc

SEQ ID NO: 75855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgccagtttttaaagggaat

SEQ ID NO: 75856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgccagtttttaaagggaa

SEQ ID NO: 75857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttgtgccagtttttaaag

SEQ ID NO: 75858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcttgtgccagtttttaaa

SEQ ID NO: 75859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatagcagtggtgagagagg

SEQ ID NO: 75860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattgaatagcagtggtgag

SEQ ID NO: 75861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caacactatattgaatagca

SEQ ID NO: 75862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccagaaattccaacactat

SEQ ID NO: 75863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccctggccagaaattccaac

SEQ ID NO: 75864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attgccctggccagaaattc

SEQ ID NO: 75865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgattgccctggccagaa

SEQ ID NO: 75866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtctgattgccctggccaga

SEQ ID NO: 75867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtctgattgccctggcca

SEQ ID NO: 75868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttgtctgattgccctggc

SEQ ID NO: 75869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttgtctgattgccctgg

SEQ ID NO: 75870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcttgtctgattgccctg

SEQ ID NO: 75871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctcttgtctgattgccc

SEQ ID NO: 75872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttctcttgtctgattgcc

SEQ ID NO: 75873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctttctcttgtctgatt

SEQ ID NO: 75874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctttctcttgtctgat

SEQ ID NO: 75875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttctttctcttgtctga

SEQ ID NO: 75876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aataccctttatttctttct

SEQ ID NO: 75877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaataccctttatttctttc

SEQ ID NO: 75878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgaataccctttatttct

SEQ ID NO: 75879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatttgaataccctttatt

SEQ ID NO: 75880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctatttgaataccctttat

SEQ ID NO: 75881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cggtcttcctatttgaatac

SEQ ID NO: 75882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccggtcttcctatttgaata

SEQ ID NO: 75883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acttccggtcttcctatttg

SEQ ID NO: 75884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacttccggtcttcctattt

SEQ ID NO: 75885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagagacaatttgacttccg

SEQ ID NO: 75886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagagacaatttgacttcc

SEQ ID NO: 75887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatatagaatcatgtcattt

SEQ ID NO: 75888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaatatagaatcatgtcat

SEQ ID NO: 75889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaatatagaatcatgtca

SEQ ID NO: 75890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaaatatagaatcatgtc

SEQ ID NO: 75891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatgatcgggttttctaaa

SEQ ID NO: 75892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggctgagatgatcgggttt

SEQ ID NO: 75893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggggctgagatgatcgggtt

SEQ ID NO: 75894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggggctgagatgatcgggt

SEQ ID NO: 75895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagagttttggggctgagat

SEQ ID NO: 75896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagagttttggggctgaga

SEQ ID NO: 75897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagtttaaagagttttggg

SEQ ID NO: 75898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcagtttaaagagttttgg

SEQ ID NO: 75899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttatcagtttaaagagttt

SEQ ID NO: 75900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagttgcttatcagtttaaa

SEQ ID NO: 75901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgaagttgcttatcagttt

SEQ ID NO: 75902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgaagttgcttatcagtt

SEQ ID NO: 75903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataccttgctgaagttgctt

SEQ ID NO: 75904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatcctgataccttgctgaa

SEQ ID NO: 75905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatcctgataccttgctga

SEQ ID NO: 75906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatcctgataccttgctg

SEQ ID NO: 75907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttgtatcctgatacctt

SEQ ID NO: 75908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacattgattttgtatcctg

SEQ ID NO: 75909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacattgattttgtatcct

SEQ ID NO: 75910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcacattgattttgtatcc

SEQ ID NO: 75911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcacattgattttgtatc

SEQ ID NO: 75912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgatttttgcacattgattt

SEQ ID NO: 75913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtataggaatgcctgtga

SEQ ID NO: 75914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttggtgtataggaatgcctg

SEQ ID NO: 75915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgttggtgtataggaatgc

SEQ ID NO: 75916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctattgttggtgtatagga

SEQ ID NO: 75917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtctattgttggtgtatagg

SEQ ID NO: 75918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttgtctattgttggtgtat

SEQ ID NO: 75919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcttgtctattgttggtgt

SEQ ID NO: 75920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgcttgtctattgttggt

SEQ ID NO: 75921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctctctgcttgtctattgt

SEQ ID NO: 75922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctctctgcttgtctattg

SEQ ID NO: 75923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgatttggctctctgcttg

SEQ ID NO: 75924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcatgatttggctctctgc

SEQ ID NO: 75925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcatgatttggctctctg

SEQ ID NO: 75926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaatgggagtttattcatg

SEQ ID NO: 75927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagcaattgcaaatgggagt

SEQ ID NO: 75928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagcaattgcaaatgggag

SEQ ID NO: 75929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatagcaattgcaaatggga

SEQ ID NO: 75930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttatagcaattgcaaatgg

SEQ ID NO: 75931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttatagcaattgcaaat

SEQ ID NO: 75932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctctttatagcaattgca

SEQ ID NO: 75933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctctttatagcaattgc

SEQ ID NO: 75934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattctctttatagcaattg

SEQ ID NO: 75935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtattttattctctttata

SEQ ID NO: 75936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaggtattttattctcttt

SEQ ID NO: 75937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattcctaggtattttattc

SEQ ID NO: 75938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagctgtattcctaggtat

SEQ ID NO: 75939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaagctgtattcctaggta

SEQ ID NO: 75940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtaagctgtattcctaggt

SEQ ID NO: 75941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatcctttgtaagctgtat

SEQ ID NO: 75942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatcctttgtaagctgta

SEQ ID NO: 75943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatatcctttgtaagctgt

SEQ ID NO: 75944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaggtctttcatatcctt

SEQ ID NO: 75945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagaggtctttcatatcct

SEQ ID NO: 75946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaagaggtctttcatatc

SEQ ID NO: 75947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagttcttgaagaggtcttt

SEQ ID NO: 75948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtagttcttgaagaggtctt

SEQ ID NO: 75949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtagtggcttgtagttctt

SEQ ID NO: 75950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtagtggcttgtagttct

SEQ ID NO: 75951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgagtagtggcttgtagt

SEQ ID NO: 75952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttgagtagtggcttgtag

SEQ ID NO: 75953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttccttgagtagtggcttg

SEQ ID NO: 75954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttccttgagtagtggctt

SEQ ID NO: 75955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtttccttgagtagtggc

SEQ ID NO: 75956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttgtttccttgagtagtg

SEQ ID NO: 75957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtcctctcttgtttccttg

SEQ ID NO: 75958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtcctctcttgtttcctt

SEQ ID NO: 75959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtgtcctctcttgtttc

SEQ ID NO: 75960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtgtcctctcttgttt

SEQ ID NO: 75961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttgtttgtgtcctctct

SEQ ID NO: 75962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatttgtttgtgtcctctc

SEQ ID NO: 75963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatttgtttgtgtcctct

SEQ ID NO: 75964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccatttgtttgtgtcctc

SEQ ID NO: 75965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tccatgagtatggaatgttt

SEQ ID NO: 75966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatccatgagtatggaatg

SEQ ID NO: 75967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctatccatgagtatggaat

SEQ ID NO: 75968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcctatccatgagtatgga

SEQ ID NO: 75969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attcttcctatccatgagta

SEQ ID NO: 75970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgacattgattcttccta

SEQ ID NO: 75971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatgacattgattcttcct

SEQ ID NO: 75972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggcagtatggccatttacat

SEQ ID NO: 75973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cggcagtatggccatttaca

SEQ ID NO: 75974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcggcagtatggccatttac

SEQ ID NO: 75975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttcggcagtatggccatt

SEQ ID NO: 75976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaattactttcggcagtat

SEQ ID NO: 75977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatctataaattactttcgg

SEQ ID NO: 75978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcattgaatctataaattac

SEQ ID NO: 75979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgggactagcattgaatct

SEQ ID NO: 75980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgggactagcattgaatc

SEQ ID NO: 75981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaagatgtcaatggtaatt

SEQ ID NO: 75982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgaagatgtcaatggtaa

SEQ ID NO: 75983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attctgtgaagatgtcaatg

SEQ ID NO: 75984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taattctgtgaagatgtcaa

SEQ ID NO: 75985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaattctgtgaagatgtca

SEQ ID NO: 75986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaattctgtgaagatgtc

SEQ ID NO: 75987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtagttttctaattctgt

SEQ ID NO: 75988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtagttttctaattctg

SEQ ID NO: 75989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatgaaatttaaagtagtt

SEQ ID NO: 75990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatgaaatttaaagtagt

SEQ ID NO: 75991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtttcatatgaaatttaaag

SEQ ID NO: 75992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggtttcatatgaaattta

SEQ ID NO: 75993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctggtttcatatgaaattt

SEQ ID NO: 75994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctggtttcatatgaaatt

SEQ ID NO: 75995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttcctggtttcatatgaaa

SEQ ID NO: 75996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgtgctctttcctggttt

SEQ ID NO: 75997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctatatgtgctctttcctgg

SEQ ID NO: 75998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctatatgtgctctttcctg

SEQ ID NO: 75999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctatatgtgctctttcct

SEQ ID NO: 76000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctttgctatatgtgctctt

SEQ ID NO: 76001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaattgtctttgctatatgt

SEQ ID NO: 76002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaattgtctttgctatatg

SEQ ID NO: 76003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttagaattgtctttgctat

SEQ ID NO: 76004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttagaattgtctttgcta

SEQ ID NO: 76005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcttagaattgtctttgct

SEQ ID NO: 76006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcttagaattgtctttgc

SEQ ID NO: 76007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgcttagaattgtctttg

SEQ ID NO: 76008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttgcttagaattgtctt

SEQ ID NO: 76009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctttttgcttagaattgt

SEQ ID NO: 76010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttctttttgcttagaattg

SEQ ID NO: 76011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttctttttgcttagaatt

SEQ ID NO: 76012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagctttgttctttttgctt

SEQ ID NO: 76013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgcctccagctttgttctt

SEQ ID NO: 76014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtcaggtaggctgatgcc

SEQ ID NO: 76015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagtcaggtaggctgatgc

SEQ ID NO: 76016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atagtatagtttgaagtcag

SEQ ID NO: 76017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taacctcatagtatagtttg

SEQ ID NO: 76018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtaacctcatagtatagt

SEQ ID NO: 76019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttactgtaacctcatagta

SEQ ID NO: 76020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttactgtaacctcatagt

SEQ ID NO: 76021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggttactgtaacctcatag

SEQ ID NO: 76022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttggttactgtaacctca

SEQ ID NO: 76023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccatgctgttttggttactg

SEQ ID NO: 76024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtaccactaccatgctgtt

SEQ ID NO: 76025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtaccactaccatgctgt

SEQ ID NO: 76026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgggtaccactaccatgc

SEQ ID NO: 76027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgtctgtttgggtaccac

SEQ ID NO: 76028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcctatatgtctgtttgggt

SEQ ID NO: 76029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattggcctatatgtctgtt

SEQ ID NO: 76030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttccattggcctatatgtct

SEQ ID NO: 76031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattccattggcctatatgt

SEQ ID NO: 76032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctattccattggcctata

SEQ ID NO: 76033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattctattccattggccta

SEQ ID NO: 76034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtctctattctattccat

SEQ ID NO: 76035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaggtctctattctattcc

SEQ ID NO: 76036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgaggtctctattctattc

SEQ ID NO: 76037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctgaggtctctattcta

SEQ ID NO: 76038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagaagtgtggtgttatttc

SEQ ID NO: 76039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtagaagtgtggtgttattt

SEQ ID NO: 76040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcgaagatcagatgcttgta

SEQ ID NO: 76041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcgaagatcagatgcttgt

SEQ ID NO: 76042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaggtttgtcgaagatcag

SEQ ID NO: 76043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcaggtttgtcgaagatca

SEQ ID NO: 76044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcaggtttgtcgaagatc

SEQ ID NO: 76045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtcaggtttgtcgaagat

SEQ ID NO: 76046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttgtcaggtttgtcgaa

SEQ ID NO: 76047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttttgtcaggtttgtcga

SEQ ID NO: 76048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgtttttgtcaggtttgt

SEQ ID NO: 76049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacattgcttgtttttgtca

SEQ ID NO: 76050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacattgcttgtttttgtc

SEQ ID NO: 76051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccacattgcttgtttttgt

SEQ ID NO: 76052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatagggaatcctttccaca

SEQ ID NO: 76053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatatagggaatcctttcc

SEQ ID NO: 76054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatatagggaatcctttc

SEQ ID NO: 76055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccagcaccatttattatat

SEQ ID NO: 76056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccccagcaccatttattata

SEQ ID NO: 76057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gccagcttccccagcaccat

SEQ ID NO: 76058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catatggctagccagcttcc

SEQ ID NO: 76059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcatatggctagccagctt

SEQ ID NO: 76060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcatatggctagccagct

SEQ ID NO: 76061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgcatatggctagccagc

SEQ ID NO: 76062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttttctgcatatggctag

SEQ ID NO: 76063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagttttctgcatatggcta

SEQ ID NO: 76064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataaggtgtaaggaaggag

SEQ ID NO: 76065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtataaggtgtaaggaagga

SEQ ID NO: 76066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtataaggtgtaaggaagg

SEQ ID NO: 76067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtataaggtgtaaggaag

SEQ ID NO: 76068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttgtataaggtgtaag

SEQ ID NO: 76069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttaatttttgtataaggt

SEQ ID NO: 76070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagttaatttttgtataagg

SEQ ID NO: 76071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atccatcttgagttaatttt

SEQ ID NO: 76072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatccatcttgagttaattt

SEQ ID NO: 76073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatccatcttgagttaatt

SEQ ID NO: 76074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtctttaatccatcttgag

SEQ ID NO: 76075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattaagtctttaatccatc

SEQ ID NO: 76076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattaagtctttaatccat

SEQ ID NO: 76077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacattaagtctttaatcca

SEQ ID NO: 76078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggttttacattaagtcttt

SEQ ID NO: 76079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggggttttacattaagtctt

SEQ ID NO: 76080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atggtttggggttttacatt

SEQ ID NO: 76081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catggtttggggttttacat

SEQ ID NO: 76082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatggtttggggttttaca

SEQ ID NO: 76083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggttttcatggtttggggt

SEQ ID NO: 76084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagggttttcatggtttggg

SEQ ID NO: 76085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctagggttttcatggtttgg

SEQ ID NO: 76086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctagggttttcatggttt

SEQ ID NO: 76087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctagggttttcatggtt

SEQ ID NO: 76088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttctagggttttcatggt

SEQ ID NO: 76089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggttttcttctagggttttc

SEQ ID NO: 76090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctaggttttcttctagggt

SEQ ID NO: 76091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatggtgttgcctaggtttt

SEQ ID NO: 76092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgaatggtgttgcctaggt

SEQ ID NO: 76093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgaatggtgttgcctagg

SEQ ID NO: 76094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcctgaatggtgttgcct

SEQ ID NO: 76095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccatgcctatttcctgaat

SEQ ID NO: 76096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcccatgcctatttcctgaa

SEQ ID NO: 76097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcccatgcctatttcctga

SEQ ID NO: 76098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatgaagtctttgcccatg

SEQ ID NO: 76099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcatgaagtctttgcccat

SEQ ID NO: 76100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcatgaagtctttgccca

SEQ ID NO: 76101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtcatgaagtctttgccc

SEQ ID NO: 76102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtatttttgtcatgaagtct

SEQ ID NO: 76103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtatttttgtcatgaagtc

SEQ ID NO: 76104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtatttttgtcatgaagt

SEQ ID NO: 76105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggtatttttgtcatgaag

SEQ ID NO: 76106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttggtatttttgtcatg

SEQ ID NO: 76107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caattgcttttggtattttt

SEQ ID NO: 76108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttgcaattgcttttggtat

SEQ ID NO: 76109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttgcaattgcttttggta

SEQ ID NO: 76110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggttgcaattgcttttggt

SEQ ID NO: 76111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctttggttgcaattgcttt

SEQ ID NO: 76112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctttggttgcaattgctt

SEQ ID NO: 76113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggctttggttgcaattgct

SEQ ID NO: 76114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaattttggctttggttgc

SEQ ID NO: 76115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcaattttggctttggttg

SEQ ID NO: 76116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcccatttgtcaattttg

SEQ ID NO: 76117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttatatcccatttgtcaat

SEQ ID NO: 76118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttatatcccatttgtcaa

SEQ ID NO: 76119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttagttatatcccatttg

SEQ ID NO: 76120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttagttatatcccattt

SEQ ID NO: 76121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtttagttatatcccatt

SEQ ID NO: 76122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttagtttagttatatccca

SEQ ID NO: 76123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcagaagctctttagttta

SEQ ID NO: 76124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtgcagaagctctttagt

SEQ ID NO: 76125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgtgcagaagctctttag

SEQ ID NO: 76126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctgtgcagaagctcttta

SEQ ID NO: 76127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgctgtgcagaagctcttt

SEQ ID NO: 76128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgctgtgcagaagctct

SEQ ID NO: 76129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttgctgtgcagaagctc

SEQ ID NO: 76130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttcttttgctgtgcagaa

SEQ ID NO: 76131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgttagtttcttttgctgt

SEQ ID NO: 76132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatgttagtttcttttgct

SEQ ID NO: 76133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actctgatgttagtttcttt

SEQ ID NO: 76134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcactctgatgttagtttc

SEQ ID NO: 76135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctgttcactctgatgttag

SEQ ID NO: 76136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctgttcactctgatgtta

SEQ ID NO: 76137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagtttgcctgttcactctg

SEQ ID NO: 76138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatagtttgcctgttcactc

SEQ ID NO: 76139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccattctatagtttgcctgt

SEQ ID NO: 76140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccattctatagtttgcct

SEQ ID NO: 76141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcccattctatagtttgcc

SEQ ID NO: 76142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcccattctatagtttgc

SEQ ID NO: 76143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcccattctatagtttg

SEQ ID NO: 76144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaaatttttctcccattct

SEQ ID NO: 76145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagatgggtagattgccaa

SEQ ID NO: 76146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcagatgggtagattgcca

SEQ ID NO: 76147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtcagatgggtagattgcc

SEQ ID NO: 76148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacctttgtcagatgggtag

SEQ ID NO: 76149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atattagacctttgtcagat

SEQ ID NO: 76150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatattagacctttgtcaga

SEQ ID NO: 76151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaatattagacctttgtca

SEQ ID NO: 76152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagattcttaatattagacc

SEQ ID NO: 76153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtagattcttaatattagac

SEQ ID NO: 76154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgtagattcttaatatta

SEQ ID NO: 76155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttacttgtagattcttaa

SEQ ID NO: 76156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagttacttgtagattctta

SEQ ID NO: 76157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaagttacttgtagattc

SEQ ID NO: 76158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttaagttacttgtagatt

SEQ ID NO: 76159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaatttgtttaagttactt

SEQ ID NO: 76160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataaatttgtttaagttact

SEQ ID NO: 76161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttataaatttgtttaagt

SEQ ID NO: 76162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attatcttataaatttgttt

SEQ ID NO: 76163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagaaatgttaattatctt

SEQ ID NO: 76164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaatagaaatgttaattat

SEQ ID NO: 76165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacaattattaatagaaatg

SEQ ID NO: 76166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattatacaattattaatag

SEQ ID NO: 76167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatgataaaagtatattaca

SEQ ID NO: 76168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatgataaaagtatattac

SEQ ID NO: 76169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtatgataaaagtatatta

SEQ ID NO: 76170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgctttgtatgataaaa

SEQ ID NO: 76171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatgctttgtatgataaa

SEQ ID NO: 76172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaatgctttgtatgataa

SEQ ID NO: 76173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actttaaaatgctttgtatg

SEQ ID NO: 76174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattcactttaaaatgcttt

SEQ ID NO: 76175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcctaaattcactttaaaat

SEQ ID NO: 76176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atactatcctaaattcactt

SEQ ID NO: 76177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatcagttgatactatcct

SEQ ID NO: 76178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatatcagttgatactatcc

SEQ ID NO: 76179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttaatatcagttgatact

SEQ ID NO: 76180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttaatatcagttgatac

SEQ ID NO: 76181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatttaatatcagttgata

SEQ ID NO: 76182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatttaatatcagttgat

SEQ ID NO: 76183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttcatttaatatcagtt

SEQ ID NO: 76184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttttcatttaatatcagt

SEQ ID NO: 76185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcagaggtaagacttattt

SEQ ID NO: 76186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcagaggtaagacttatt

SEQ ID NO: 76187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatcagaggtaagacttat

SEQ ID NO: 76188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatcagaggtaagactta

SEQ ID NO: 76189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataatttttcatcagagg

SEQ ID NO: 76190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaaacacaaataaaaaaa

SEQ ID NO: 76191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaattaaagaaacacaaat

SEQ ID NO: 76192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcaaaattaaagaaacaca

SEQ ID NO: 76193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcaaaattaaagaaacac

SEQ ID NO: 76194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactcaaaattaaagaaaca

SEQ ID NO: 76195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatgcaagaagtggtcac

SEQ ID NO: 76196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatatgcaagaagtggtca

SEQ ID NO: 76197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatatgcaagaagtggtc

SEQ ID NO: 76198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatatgcaagaagtggt

SEQ ID NO: 76199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaatatgcaagaagtgg

SEQ ID NO: 76200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagcaaaaatgggaatgcaa

SEQ ID NO: 76201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagcaaaaatgggaatgca

SEQ ID NO: 76202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacagcaaaaatgggaatgc

SEQ ID NO: 76203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtaagatgcactttacagc

SEQ ID NO: 76204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggaaattatgtaagatgcac

SEQ ID NO: 76205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaatgaattcggaaattat

SEQ ID NO: 76206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgagaatattataaatgaat

SEQ ID NO: 76207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccgagaatattataaatgaa

SEQ ID NO: 76208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttccgagaatattataaat

SEQ ID NO: 76209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttccgagaatattataaa

SEQ ID NO: 76210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttccgagaatattataa

SEQ ID NO: 76211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttatttccgagaatatta

SEQ ID NO: 76212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actttatttccgagaatatt

SEQ ID NO: 76213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttactttatttccgaga

SEQ ID NO: 76214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttactttatttccgag

SEQ ID NO: 76215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatttactttatttccga

SEQ ID NO: 76216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttatatttactttatttc

SEQ ID NO: 76217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcctattttatatttacttt

SEQ ID NO: 76218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcctattttatatttactt

SEQ ID NO: 76219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggcctattttatatttact

SEQ ID NO: 76220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggcctattttatatttac

SEQ ID NO: 76221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttggcctattttatattta

SEQ ID NO: 76222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttggcctattttatattt

SEQ ID NO: 76223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttggcctattttatat

SEQ ID NO: 76224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttttggcctattttata

SEQ ID NO: 76225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttttggcctattttat

SEQ ID NO: 76226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttttttggcctatttta

SEQ ID NO: 76227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttttttggcctatttt

SEQ ID NO: 76228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcttttttggcctattt

SEQ ID NO: 76229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttcttttttggcctatt

SEQ ID NO: 76230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttcttttttggcctat

SEQ ID NO: 76231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttttttcttttttggcc

SEQ ID NO: 76232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagatctgtttttttttctt

SEQ ID NO: 76233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaatagctgcagatctgtt

SEQ ID NO: 76234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagaatagctgcagatctg

SEQ ID NO: 76235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcagaatagctgcagatct

SEQ ID NO: 76236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcagaatagctgcagatc

SEQ ID NO: 76237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctcagaatagctgcagat

SEQ ID NO: 76238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttttctcagaatagctgc

SEQ ID NO: 76239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagtacacataacaatgatt

SEQ ID NO: 76240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatagtacacataacaatga

SEQ ID NO: 76241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctatagtacacataacaa

SEQ ID NO: 76242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcagccaagccaaaaggaa

SEQ ID NO: 76243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatagtctcagcagccaagc

SEQ ID NO: 76244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtatagtctcagcagccaag

SEQ ID NO: 76245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgtatagtctcagcagcc

SEQ ID NO: 76246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttgtatagtctcagcagc

SEQ ID NO: 76247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catttacttgtatagtctca

SEQ ID NO: 76248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggtctccatttacttgtat

SEQ ID NO: 76249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggctgtggtctccatttac

SEQ ID NO: 76250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggggctgtggtctccattta

SEQ ID NO: 76251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttggggctgtggtctccatt

SEQ ID NO: 76252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgtgaacctcttggggct

SEQ ID NO: 76253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatgtgaacctcttggggc

SEQ ID NO: 76254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acttgaatgtgaacctcttg

SEQ ID NO: 76255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taacttgaatgtgaacctct

SEQ ID NO: 76256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctaacttgaatgtgaacc

SEQ ID NO: 76257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctctaacttgaatgtgaac

SEQ ID NO: 76258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcctctaacttgaatgtg

SEQ ID NO: 76259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtggctatttcctctaac

SEQ ID NO: 76260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caagtggtaattcatgtggc

SEQ ID NO: 76261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattgcaagtggtaattcat

SEQ ID NO: 76262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtattgcaagtggtaattca

SEQ ID NO: 76263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtattgcaagtggtaatt

SEQ ID NO: 76264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atctcttgtattgcaagtgg

SEQ ID NO: 76265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcattgatctcttgtatt

SEQ ID NO: 76266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatcattgatctcttgtat

SEQ ID NO: 76267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttatatcattgatctct

SEQ ID NO: 76268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatttatatcattgatctc

SEQ ID NO: 76269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccatttatatcattgatc

SEQ ID NO: 76270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttccatttatatcattgat

SEQ ID NO: 76271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttccatttatatcattga

SEQ ID NO: 76272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattttcttccatttatatc

SEQ ID NO: 76273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattttcttccatttatat

SEQ ID NO: 76274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtattttcttccatttata

SEQ ID NO: 76275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtattttcttccatttat

SEQ ID NO: 76276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtattttcttccattta

SEQ ID NO: 76277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgattttttgtattttct

SEQ ID NO: 76278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatgattttttgtattttc

SEQ ID NO: 76279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagacttccatgattttttg

SEQ ID NO: 76280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaactgtagacttccatga

SEQ ID NO: 76281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcccaactgtagacttcca

SEQ ID NO: 76282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaatcaattgctcccaac

SEQ ID NO: 76283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcccaaatcaattgctccca

SEQ ID NO: 76284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcccaaatcaattgctcc

SEQ ID NO: 76285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctcccaaatcaattgctc

SEQ ID NO: 76286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctcccaaatcaattgct

SEQ ID NO: 76287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctctcccaaatcaattgc

SEQ ID NO: 76288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtttttctctcccaaatca

SEQ ID NO: 76289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagtttttctctcccaaat

SEQ ID NO: 76290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaagtttttctctcccaa

SEQ ID NO: 76291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctaagtttttctctccca

SEQ ID NO: 76292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttctctaagtttttctct

SEQ ID NO: 76293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagatgcaattcatttctct

SEQ ID NO: 76294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagttaaagatgcaattcat

SEQ ID NO: 76295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagttaaagatgcaattca

SEQ ID NO: 76296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttaaagttaaagatgcaat

SEQ ID NO: 76297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctatttaaagttaaagatgc

SEQ ID NO: 76298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactcctatttaaagttaaa

SEQ ID NO: 76299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaactcctatttaaagttaa

SEQ ID NO: 76300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaactcctatttaaagtta

SEQ ID NO: 76301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaactcctatttaaagtt

SEQ ID NO: 76302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttgaactcctatttaaa

SEQ ID NO: 76303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttgaactcctatttaa

SEQ ID NO: 76304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttttgaactcctattta

SEQ ID NO: 76305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accatgttttatttttgaac

SEQ ID NO: 76306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcaccatgttttatttttg

SEQ ID NO: 76307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctgctcaccatgttttat

SEQ ID NO: 76308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgttcacctgctcaccatg

SEQ ID NO: 76309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatgttcacctgctcacca

SEQ ID NO: 76310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgatgttcacctgctcac

SEQ ID NO: 76311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagagaagaggctctctgat

SEQ ID NO: 76312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggatggcctgaagagaagag

SEQ ID NO: 76313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggatggcctgaagagaaga

SEQ ID NO: 76314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgcgtgcttgggatggcc

SEQ ID NO: 76315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatgcgtgcttgggatggc

SEQ ID NO: 76316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatgcgtgcttgggatgg

SEQ ID NO: 76317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttccatgcgtgcttggga

SEQ ID NO: 76318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacatggactgttttccatg

SEQ ID NO: 76319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcacatggactgttttcc

SEQ ID NO: 76320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcctgcacatggactgttt

SEQ ID NO: 76321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagctgctcctgcacatgga

SEQ ID NO: 76322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaagctgctcctgcacatg

SEQ ID NO: 76323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaagctgctcctgcacat

SEQ ID NO: 76324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcaagctgctcctgcaca

SEQ ID NO: 76325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatgttttctcaagctgct

SEQ ID NO: 76326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtaccaggacatactgtaa

SEQ ID NO: 76327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttaagtaccaggacatact

SEQ ID NO: 76328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtatatcatcccatggggt

SEQ ID NO: 76329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgagtatatcatcccatgg

SEQ ID NO: 76330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgagtatatcatcccatg

SEQ ID NO: 76331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gccttcctgagtatatcatc

SEQ ID NO: 76332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcgccttcctgagtatatca

SEQ ID NO: 76333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatctctcgccttcctgagt

SEQ ID NO: 76334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagatctctcgccttcctga

SEQ ID NO: 76335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctctagatctctcgcctt

SEQ ID NO: 76336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatctctagatctctcgcct

SEQ ID NO: 76337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcatatttaatctctagat

SEQ ID NO: 76338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggcatatttaatctctag

SEQ ID NO: 76339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgggcatatttaatctcta

SEQ ID NO: 76340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgggcatatttaatctct

SEQ ID NO: 76341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctgggcatatttaatctc

SEQ ID NO: 76342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttttctgggcatatttaa

SEQ ID NO: 76343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcttttctgggcatattta

SEQ ID NO: 76344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatcttttctgggcatatt

SEQ ID NO: 76345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttatcttttctgggcatat

SEQ ID NO: 76346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttatcttttctgggcata

SEQ ID NO: 76347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gaatcataaataattttctt

SEQ ID NO: 76348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcgaatcataaataattttc

SEQ ID NO: 76349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataatatgggtagttctcga

SEQ ID NO: 76350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccatcactaataatatgggt

SEQ ID NO: 76351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcccatcactaataatatg

SEQ ID NO: 76352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcccatcactaataatat

SEQ ID NO: 76353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactcccatcactaataata

SEQ ID NO: 76354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagtgttttactcccatca

SEQ ID NO: 76355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaaaattataagtgtttta

SEQ ID NO: 76356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaccaaaattataagtgtt

SEQ ID NO: 76357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attaccaaaattataagtgt

SEQ ID NO: 76358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttattaccaaaattataa

SEQ ID NO: 76359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatcttattaccaaaatta

SEQ ID NO: 76360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattatcttattaccaaaat

SEQ ID NO: 76361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaatggaggaaactctatt

SEQ ID NO: 76362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaatggaggaaactctat

SEQ ID NO: 76363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgagaatggaggaaactc

SEQ ID NO: 76364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgagaatggaggaaact

SEQ ID NO: 76365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatttgagaatggaggaa

SEQ ID NO: 76366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatttgagaatggagga

SEQ ID NO: 76367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttatttgagaatggagg

SEQ ID NO: 76368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttatttgagaatggag

SEQ ID NO: 76369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatttatttgagaatgga

SEQ ID NO: 76370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaggttttttatttatttg

SEQ ID NO: 76371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattaggaggttttttattt

SEQ ID NO: 76372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagcctgtattaggaggtt

SEQ ID NO: 76373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgtatgttaagagcctgta

SEQ ID NO: 76374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatggcatatgtacctggtg

SEQ ID NO: 76375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatggcatatgtacctggt

SEQ ID NO: 76376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaatggcatatgtacctgg

SEQ ID NO: 76377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaatggcatatgtacctg

SEQ ID NO: 76378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttgaatggcatatgt

SEQ ID NO: 76379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaacaggtgagtaccaaga

SEQ ID NO: 76380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accaacaggtgagtaccaag

SEQ ID NO: 76381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taccaacaggtgagtaccaa

SEQ ID NO: 76382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaaaacctttaccaacagg

SEQ ID NO: 76383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgggaaaacctttaccaac

SEQ ID NO: 76384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgacccaagattactggga

SEQ ID NO: 76385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggctaatgacccaagattac

SEQ ID NO: 76386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggctaatgacccaagatta

SEQ ID NO: 76387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaggctaatgacccaaga

SEQ ID NO: 76388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttaggctaatgacccaag

SEQ ID NO: 76389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccttgtttaggctaatgac

SEQ ID NO: 76390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agccttgtttaggctaatga

SEQ ID NO: 76391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagccttgtttaggctaat

SEQ ID NO: 76392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttagccttgtttaggctaa

SEQ ID NO: 76393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggccttcttagccttgttta

SEQ ID NO: 76394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctgggccttcttagcctt

SEQ ID NO: 76395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagctgggccttcttagcct

SEQ ID NO: 76396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagctgggccttcttagcc

SEQ ID NO: 76397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acactttcagctgggccttc

SEQ ID NO: 76398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacactttcagctgggcctt

SEQ ID NO: 76399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgacactttcagctgggcct

SEQ ID NO: 76400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacgagctttgacactttca

SEQ ID NO: 76401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggctacacgagctttgaca

SEQ ID NO: 76402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attatggctacacgagcttt

SEQ ID NO: 76403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcagaaaccctgattatggc

SEQ ID NO: 76404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgaaaattggcagaaacc

SEQ ID NO: 76405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gtgtgtagtcagtgtccaga

SEQ ID NO: 76406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcgtgtgtagtcagtgtcca

SEQ ID NO: 76407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcgtgtgtagtcagtgtcc

SEQ ID NO: 76408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcgtgtgtagtcagtgtc

SEQ ID NO: 76409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctcgtgtgtagtcagtg

SEQ ID NO: 76410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taatgttctttctcgtgtgt

SEQ ID NO: 76411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acctataatgttctttctcg

SEQ ID NO: 76412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcacctataatgttctttct

SEQ ID NO: 76413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagacactctcacctataat

SEQ ID NO: 76414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtcctgaagacactctcac

SEQ ID NO: 76415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgtcctgaagacactctca

SEQ ID NO: 76416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcttgtgtcctgaagacact

SEQ ID NO: 76417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcttgtgtcctgaagacac

SEQ ID NO: 76418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttagcttgtgtcctgaaga

SEQ ID NO: 76419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtaaggctatttagcttgt

SEQ ID NO: 76420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtaaggctatttagcttg

SEQ ID NO: 76421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtaaggctatttagctt

SEQ ID NO: 76422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcagtaaggctatttagct

SEQ ID NO: 76423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taacttttcagtaaggctat

SEQ ID NO: 76424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaacttttcagtaaggcta

SEQ ID NO: 76425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtttgtaacttttcagtaa

SEQ ID NO: 76426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtttgtaacttttcagta

SEQ ID NO: 76427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagaagaaaccttgagtttg

SEQ ID NO: 76428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccccctatagaagaaacct

SEQ ID NO: 76429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatattgtccccctatagaa

SEQ ID NO: 76430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaatattgtccccctata

SEQ ID NO: 76431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcaatattgtccccctat

SEQ ID NO: 76432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atccttattcaatattgtcc

SEQ ID NO: 76433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatccttattcaatattgtc

SEQ ID NO: 76434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaatccttattcaatattg

SEQ ID NO: 76435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtagtcagtagccaaatca

SEQ ID NO: 76436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaaagtcactaagtagtca

SEQ ID NO: 76437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaaagtcactaagtagtc

SEQ ID NO: 76438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaatttggtaaagtcact

SEQ ID NO: 76439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagaatttggtaaagtcac

SEQ ID NO: 76440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgccttgaagaatttggtaa

SEQ ID NO: 76441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgccttgaagaatttggta

SEQ ID NO: 76442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagacagacttatgccttg

SEQ ID NO: 76443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacagacagacttatgcctt

SEQ ID NO: 76444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacagacagacttatgcct

SEQ ID NO: 76445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttcacagacagacttatg

SEQ ID NO: 76446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctattttcacagacagac

SEQ ID NO: 76447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatcctattttcacagaca

SEQ ID NO: 76448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggtagatgttattatccta

SEQ ID NO: 76449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggtagatgttattatcct

SEQ ID NO: 76450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaggtagatgttattatc

SEQ ID NO: 76451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgaggtagatgttattat

SEQ ID NO: 76452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgaggtagatgttatta

SEQ ID NO: 76453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcttgaggtagatgtta

SEQ ID NO: 76454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttcttgaggtagatgtt

SEQ ID NO: 76455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagtcttattttcttgagg

SEQ ID NO: 76456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacaagtcttattttcttg

SEQ ID NO: 76457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attacaagtcttattttctt

SEQ ID NO: 76458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacttattacaagtcttatt

SEQ ID NO: 76459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacttattacaagtcttat

SEQ ID NO: 76460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaaacttattacaagtct

SEQ ID NO: 76461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttaaacttattacaagtc

SEQ ID NO: 76462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttatttaaacttattaca

SEQ ID NO: 76463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacacattatcttatttaaa

SEQ ID NO: 76464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacacattatcttatttaa

SEQ ID NO: 76465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtaatttgtacacattatc

SEQ ID NO: 76466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgcaggatgtaagctaag

SEQ ID NO: 76467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgtgcaggatgtaagcta

SEQ ID NO: 76468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatgtgcaggatgtaagct

SEQ ID NO: 76469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctatgtgcaggatgtaagc

SEQ ID NO: 76470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacactttctatgtgcagga

SEQ ID NO: 76471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaacactttctatgtgca

SEQ ID NO: 76472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaaacactttctatgtgc

SEQ ID NO: 76473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatttattaaacactttct

SEQ ID NO: 76474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atggcagctatgatttatta

SEQ ID NO: 76475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgatgatgatgctaatggc

SEQ ID NO: 76476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgatgatgatgctaatgg

SEQ ID NO: 76477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgatgatgatgctaatg

SEQ ID NO: 76478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgttttaatgatgatgat

SEQ ID NO: 76479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatgttttaatgatgatga

SEQ ID NO: 76480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaatttccatgttttaatg

SEQ ID NO: 76481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgaaaatttccatgtttta

SEQ ID NO: 76482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcacaaaacgtctgttgaaa

SEQ ID NO: 76483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaccaagaactatcacaaaa

SEQ ID NO: 76484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgaaccaagaactatcaca

SEQ ID NO: 76485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgaaccaagaactatcac

SEQ ID NO: 76486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catatcaatatttactgaac

SEQ ID NO: 76487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaacagcctacatatcaat

SEQ ID NO: 76488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaacagcctacatatcaa

SEQ ID NO: 76489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtaacagcctacatatca

SEQ ID NO: 76490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacagacagaaagagctttg

SEQ ID NO: 76491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagaattatacagacagaa

SEQ ID NO: 76492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttccaagaattatacagaca

SEQ ID NO: 76493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atctattccaagaattatac

SEQ ID NO: 76494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatctattccaagaattat

SEQ ID NO: 76495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actctaatctattccaagaa

SEQ ID NO: 76496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgactctaatctattccaa

SEQ ID NO: 76497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttattgactctaatctattc

SEQ ID NO: 76498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actattattgactctaatct

SEQ ID NO: 76499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactattattgactctaatc

SEQ ID NO: 76500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgactattattgactctaat

SEQ ID NO: 76501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattttgactattattgact

SEQ ID NO: 76502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatattttgactattattg

SEQ ID NO: 76503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacaattactatattttgac

SEQ ID NO: 76504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agacaattactatattttga

SEQ ID NO: 76505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaacttagacaattactat

SEQ ID NO: 76506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaacttagacaattacta

SEQ ID NO: 76507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgaacttagacaattact

SEQ ID NO: 76508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatgaacttagacaattac

SEQ ID NO: 76509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacatttttatgaacttaga

SEQ ID NO: 76510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagctgcacatttttatgaa

SEQ ID NO: 76511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagctgcacatttttatga

SEQ ID NO: 76512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaagaaaaaagtcttaaag

SEQ ID NO: 76513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaagaaaaaagtcttaaa

SEQ ID NO: 76514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaaagaaaaaagtcttaa

SEQ ID NO: 76515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggcatcaggaaaaaccag

SEQ ID NO: 76516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatggcatcaggaaaaacca

SEQ ID NO: 76517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaatggcatcaggaaaaa

SEQ ID NO: 76518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttaatggcatcaggaaaa

SEQ ID NO: 76519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttatttaatggcatcag

SEQ ID NO: 76520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaatattgtatttatttaa

SEQ ID NO: 76521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagaagaatctcagaatat

SEQ ID NO: 76522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcccagaagaatctcagaa

SEQ ID NO: 76523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgttcccagaagaatctca

SEQ ID NO: 76524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gataaggttgctgttcccag

SEQ ID NO: 76525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaacataggaataaactgg

SEQ ID NO: 76526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtacactggcaacatagga

SEQ ID NO: 76527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtgtacactggcaacatag

SEQ ID NO: 76528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcaggctctgtgtacactg

SEQ ID NO: 76529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcatcaggctctgtgtaca

SEQ ID NO: 76530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcagacatctattcatcag

SEQ ID NO: 76531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccctatgcagacatctatt

SEQ ID NO: 76532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccctatgcagacatctat

SEQ ID NO: 76533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccccctatgcagacatcta

SEQ ID NO: 76534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccccctatgcagacatct

SEQ ID NO: 76535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttccccctatgcagaca

SEQ ID NO: 76536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcttttccccctatgcagac

SEQ ID NO: 76537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgcttttccccctatgcag

SEQ ID NO: 76538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cataagctcttgcttttccc

SEQ ID NO: 76539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagcatcagctgcataagct

SEQ ID NO: 76540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagcatcagctgcataagc

SEQ ID NO: 76541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtagcatcagctgcataag

SEQ ID NO: 76542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttgtagcatcagctgca

SEQ ID NO: 76543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattttgtagcatcagctgc

SEQ ID NO: 76544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caccaacttcattttgtagc

SEQ ID NO: 76545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaccaacttcattttgtag

SEQ ID NO: 76546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttacaccaacttcattttgt

SEQ ID NO: 76547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttacaccaacttcatttt

SEQ ID NO: 76548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcttacaccaacttcatt

SEQ ID NO: 76549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctcttacaccaacttcat

SEQ ID NO: 76550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttctctcttacaccaactt

SEQ ID NO: 76551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgcttctctcttacaccaa

SEQ ID NO: 76552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgcttctctcttacacca

SEQ ID NO: 76553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tccatcttgctgcttctctc

SEQ ID NO: 76554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aactgtccatcttgctgctt

SEQ ID NO: 76555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatatattcaactgtccatc

SEQ ID NO: 76556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatatataagaatattgtat

SEQ ID NO: 76557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaatattgtatatataaga

SEQ ID NO: 76558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaatattgtatatataag

SEQ ID NO: 76559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagaatattgtatatataa

SEQ ID NO: 76560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtacacatattttaagaat

SEQ ID NO: 76561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggtacacatattttaagaa

SEQ ID NO: 76562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacttgggtacacatatttt

SEQ ID NO: 76563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggacttgggtacacatattt

SEQ ID NO: 76564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttggacttgggtacacata

SEQ ID NO: 76565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcaaagggattccttggac

SEQ ID NO: 76566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagcaaagggattccttgg

SEQ ID NO: 76567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccactctaagcaaagggat

SEQ ID NO: 76568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggccactctaagcaaaggga

SEQ ID NO: 76569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggccactctaagcaaaggg

SEQ ID NO: 76570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatgtcatgttttggccact

SEQ ID NO: 76571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataggtgactgaatgtcatg

SEQ ID NO: 76572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgtgactcataggtgact

SEQ ID NO: 76573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caattaaatgtgactcatag

SEQ ID NO: 76574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccaattaaatgtgactcat

SEQ ID NO: 76575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attctccaattaaatgtgac

SEQ ID NO: 76576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactcattctccaattaaat

SEQ ID NO: 76577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaagttccactcattctcc

SEQ ID NO: 76578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcccaagttccactcattc

SEQ ID NO: 76579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactcccaagttccactcat

SEQ ID NO: 76580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctactcccaagttccactca

SEQ ID NO: 76581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctactcccaagttccactc

SEQ ID NO: 76582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctactcccaagttccac

SEQ ID NO: 76583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttctactcccaagttcca

SEQ ID NO: 76584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttctactcccaagttcc

SEQ ID NO: 76585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttctactcccaagttc

SEQ ID NO: 76586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttttctttctactcccaag

SEQ ID NO: 76587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaaacgaagagtcacaaag

SEQ ID NO: 76588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaaaacgaagagtcacaa

SEQ ID NO: 76589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggaaaacgaagagtcaca

SEQ ID NO: 76590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctggaaaacgaagagtcac

SEQ ID NO: 76591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctggaaaacgaagagtc

SEQ ID NO: 76592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttctggaaaacgaagagt

SEQ ID NO: 76593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggtcttctttctggaaaac

SEQ ID NO: 76594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggtcttctttctggaaaa

SEQ ID NO: 76595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gataatttcaggtcttcttt

SEQ ID NO: 76596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttggataatttcaggtctt

SEQ ID NO: 76597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caccaaaagttggttggata

SEQ ID NO: 76598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaaactccaccaaaagttg

SEQ ID NO: 76599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagaaaactccaccaaaagt

SEQ ID NO: 76600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctagaaaactccaccaaaag

SEQ ID NO: 76601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttctagaaaactccaccaa

SEQ ID NO: 76602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaggtagaaaatgttact

SEQ ID NO: 76603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagaaggtagaaaatgttac

SEQ ID NO: 76604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acacaagacagaagtcatat

SEQ ID NO: 76605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gaattaacacaagacagaag

SEQ ID NO: 76606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacagtgctcgaattaaca

SEQ ID NO: 76607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagacagtgctcgaattaac

SEQ ID NO: 76608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagacagtgctcgaattaa

SEQ ID NO: 76609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagcaagactttgagacag

SEQ ID NO: 76610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaagcaagactttgagaca

SEQ ID NO: 76611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgaaagcaagactttgaga

SEQ ID NO: 76612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgcatactcttgaaagcaa

SEQ ID NO: 76613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagttaatgcatactcttg

SEQ ID NO: 76614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgttcacagttaatgca

SEQ ID NO: 76615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatgttcacagttaatgc

SEQ ID NO: 76616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaatgttcacagttaatg

SEQ ID NO: 76617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcccacagcaaatccagtct

SEQ ID NO: 76618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtcccacagcaaatccagt

SEQ ID NO: 76619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attctgtcccacagcaaatc

SEQ ID NO: 76620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actcattctgtcccacagca

SEQ ID NO: 76621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactcattctgtcccacagc

SEQ ID NO: 76622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgactcattctgtcccac

SEQ ID NO: 76623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atggtattatttgactcatt

SEQ ID NO: 76624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catggtattatttgactcat

SEQ ID NO: 76625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatttcatggtattattt

SEQ ID NO: 76626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatatttcatggtattatt

SEQ ID NO: 76627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatatttcatggtattat

SEQ ID NO: 76628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatatatttcatggtatta

SEQ ID NO: 76629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttatatatttcatggtatt

SEQ ID NO: 76630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttttatatatttcatggt

SEQ ID NO: 76631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattgctttttatatatttc

SEQ ID NO: 76632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatattgctttttatatatt

SEQ ID NO: 76633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attctatattgctttttata

SEQ ID NO: 76634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattctatattgctttttat

SEQ ID NO: 76635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgattctatattgcttttta

SEQ ID NO: 76636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtctttgattctatattgct

SEQ ID NO: 76637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaattagtctttgattcta

SEQ ID NO: 76638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaaattagtctttgattct

SEQ ID NO: 76639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtcagtttgcaaattagtc

SEQ ID NO: 76640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagagaaggaaaagaatgt

SEQ ID NO: 76641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaggctgaaagagaaggaaa

SEQ ID NO: 76642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtctaaaggctgaaagagaa

SEQ ID NO: 76643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtctaaaggctgaaagaga

SEQ ID NO: 76644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtctaaaggctgaaagag

SEQ ID NO: 76645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtctaaaggctgaaaga

SEQ ID NO: 76646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttagtctaaaggctgaaag

SEQ ID NO: 76647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttagtctaaaggctgaa

SEQ ID NO: 76648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttagtctaaaggctga

SEQ ID NO: 76649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttttagtctaaaggctg

SEQ ID NO: 76650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttctttttagtctaaagg

SEQ ID NO: 76651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttctttttagtctaaag

SEQ ID NO: 76652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agggtatgtaatatttgttt

SEQ ID NO: 76653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcacagattcagggtatgt

SEQ ID NO: 76654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcacagattcagggtatg

SEQ ID NO: 76655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggtttcagcacagattcag

SEQ ID NO: 76656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggtttcagcacagattca

SEQ ID NO: 76657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtggtttcagcacagattc

SEQ ID NO: 76658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctttgtggtttcagcacaga

SEQ ID NO: 76659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcctttgtggtttcagcaca

SEQ ID NO: 76660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaggatccaaagatgctct

SEQ ID NO: 76661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaaggatccaaagatgctc

SEQ ID NO: 76662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttggaaggatccaaagatg

SEQ ID NO: 76663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacttggaaggatccaaag

SEQ ID NO: 76664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attacttggaaggatccaaa

SEQ ID NO: 76665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattacttggaaggatccaa

SEQ ID NO: 76666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattacttggaaggatcca

SEQ ID NO: 76667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacagaatatttttattact

SEQ ID NO: 76668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caacagaatatttttattac

SEQ ID NO: 76669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcaacagaatatttttatt

SEQ ID NO: 76670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttcaacagaatatttttat

SEQ ID NO: 76671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttcaacagaatattttt

SEQ ID NO: 76672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaattcttcttcaacagaat

SEQ ID NO: 76673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcaaattcttcttcaacag

SEQ ID NO: 76674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taactgttcaaattcttctt

SEQ ID NO: 76675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgatgttataactgttcaaa

SEQ ID NO: 76676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtctgtgatgttataact

SEQ ID NO: 76677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcacaatcacagattaaagt

SEQ ID NO: 76678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcacaatcacagattaaag

SEQ ID NO: 76679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatcacaatcacagattaaa

SEQ ID NO: 76680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctttatcacaatcacagatt

SEQ ID NO: 76681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctcctttatcacaatcaca

SEQ ID NO: 76682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctcctttatcacaatcac

SEQ ID NO: 76683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttacctcctttatcacaa

SEQ ID NO: 76684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatcaattaatttacctcct

SEQ ID NO: 76685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagataaatgtctatatcaa

SEQ ID NO: 76686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagataaatgtctatatca

SEQ ID NO: 76687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatttgtagataaatgtcta

SEQ ID NO: 76688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaccaggcctgaatttgta

SEQ ID NO: 76689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctgggaccaggcctgaatt

SEQ ID NO: 76690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agggagaatatatgagaaaa

SEQ ID NO: 76691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagggagaatatatgagaaa

SEQ ID NO: 76692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaataaatatttgagggag

SEQ ID NO: 76693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agagattatcaataaatatt

SEQ ID NO: 76694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagagattatcaataaata

SEQ ID NO: 76695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcctctaagagattatcaat

SEQ ID NO: 76696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctagcctctaagagattat

SEQ ID NO: 76697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcctagcctctaagagat

SEQ ID NO: 76698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgcctagcctctaagaga

SEQ ID NO: 76699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatgtttattgcctagcct

SEQ ID NO: 76700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtcatgtttattgcctag

SEQ ID NO: 76701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgtcatgtttattgccta

SEQ ID NO: 76702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcgtgtttattgtcatgttt

SEQ ID NO: 76703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcgtgtttattgtcatgtt

SEQ ID NO: 76704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatcgtgtttattgtcat

SEQ ID NO: 76705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatcgtgtttattgtca

SEQ ID NO: 76706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttatcgtgtttattgtc

SEQ ID NO: 76707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgattttatttatcgtgtt

SEQ ID NO: 76708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataaaactaatgattttatt

SEQ ID NO: 76709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacataaaggaggtctcata

SEQ ID NO: 76710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acctaaacataaaggaggtc

SEQ ID NO: 76711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caccctcacctaaacataaa

SEQ ID NO: 76712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccaaccacaacctccaccc

SEQ ID NO: 76713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccaaccacaacctccacc

SEQ ID NO: 76714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatccaaccacaacctccac

SEQ ID NO: 76715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatccaaccacaacctcca

SEQ ID NO: 76716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttttatccaaccacaac

SEQ ID NO: 76717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatttttatccaaccacaa

SEQ ID NO: 76718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttaaatttttatccaacca

SEQ ID NO: 76719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttaaatttttatccaacc

SEQ ID NO: 76720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttacttaaatttttatcca

SEQ ID NO: 76721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttacttaaatttttatcc

SEQ ID NO: 76722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatttacttaaattttta

SEQ ID NO: 76723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatttacttaaattttt

SEQ ID NO: 76724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatatttatttatttactta

SEQ ID NO: 76725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtatatttatttatttactt

SEQ ID NO: 76726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaatatcttgtatatttat

SEQ ID NO: 76727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctgaaaatatcttgtatat

SEQ ID NO: 76728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcactatctgaaaatatctt

SEQ ID NO: 76729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcactatctgaaaatatct

SEQ ID NO: 76730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatcatttatcactatctga

SEQ ID NO: 76731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatcatttatcactatctg

SEQ ID NO: 76732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagatcatttatcactatct

SEQ ID NO: 76733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttagatcatttatcactat

SEQ ID NO: 76734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttagatcatttatcacta

SEQ ID NO: 76735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttagatcatttatcact

SEQ ID NO: 76736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttctttagatcatttatc

SEQ ID NO: 76737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttctttagatcatttat

SEQ ID NO: 76738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttattttctttagatcat

SEQ ID NO: 76739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatttattttctttagatca

SEQ ID NO: 76740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccttaatttattttctttag

SEQ ID NO: 76741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccacgttgccttaatttatt

SEQ ID NO: 76742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagcctaccacgttgcctta

SEQ ID NO: 76743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actgcagcctaccacgttgc

SEQ ID NO: 76744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaagaccgtccctgactgc

SEQ ID NO: 76745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaaagaccgtccctgactg

SEQ ID NO: 76746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttagaaagaccgtccctga

SEQ ID NO: 76747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatcatctccttagaaag

SEQ ID NO: 76748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatatcatctccttagaaa

SEQ ID NO: 76749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttaaatatcatctcctta

SEQ ID NO: 76750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtttaaatatcatctcctt

SEQ ID NO: 76751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtcttagtttaaatatcat

SEQ ID NO: 76752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggtcttagtttaaatatca

SEQ ID NO: 76753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcacacttaggtcttagttt

SEQ ID NO: 76754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcacacttaggtcttagtt

SEQ ID NO: 76755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtcacacttaggtcttagt

SEQ ID NO: 76756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgtcacacttaggtctta

SEQ ID NO: 76757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttgtcacacttaggtctt

SEQ ID NO: 76758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttctttgtcacacttagg

SEQ ID NO: 76759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atggctgtcttctttgtcac

SEQ ID NO: 76760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catggctgtcttctttgtca

SEQ ID NO: 76761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatggctgtcttctttgtc

SEQ ID NO: 76762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accagtattttcatggctgt

SEQ ID NO: 76763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caccagtattttcatggctg

SEQ ID NO: 76764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcaccagtattttcatggc

SEQ ID NO: 76765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccccagcccaaatatctctt

SEQ ID NO: 76766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccccagcccaaatatctct

SEQ ID NO: 76767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcccccagcccaaatatct

SEQ ID NO: 76768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttcccccagcccaaatat

SEQ ID NO: 76769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttcccccagcccaaata

SEQ ID NO: 76770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcttcccccagcccaaat

SEQ ID NO: 76771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctcttcccccagcccaa

SEQ ID NO: 76772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttctttctcttcccccagc

SEQ ID NO: 76773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttctttctcttcccccag

SEQ ID NO: 76774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagttctttctcttccccca

SEQ ID NO: 76775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggctttagttctttctctt

SEQ ID NO: 76776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agggctttagttctttctct

SEQ ID NO: 76777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccttagggctttagttcttt

SEQ ID NO: 76778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgccttagggctttagttct

SEQ ID NO: 76779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctctgccttagggcttta

SEQ ID NO: 76780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catctctgccttagggcttt

SEQ ID NO: 76781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacacaccaacttcatctct

SEQ ID NO: 76782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacacaccaacttcatctc

SEQ ID NO: 76783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccacacaccaacttcatct

SEQ ID NO: 76784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccacacaccaacttcatc

SEQ ID NO: 76785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttttccacacaccaactt

SEQ ID NO: 76786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctggcttttccacacaccaa

SEQ ID NO: 76787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctggcttttccacacacca

SEQ ID NO: 76788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccatcttgctggcttttcc

SEQ ID NO: 76789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagccacactggccatcttg

SEQ ID NO: 76790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accacactgtagccacactg

SEQ ID NO: 76791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaccacactgtagccacac

SEQ ID NO: 76792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctctcaccacactgtagcc

SEQ ID NO: 76793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccatcacaatcctccctctc

SEQ ID NO: 76794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgccatcacaatcctccctc

SEQ ID NO: 76795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctctgccatcacaatcctc

SEQ ID NO: 76796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctacctctgccatcacaat

SEQ ID NO: 76797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgacatgatccggcccctgc

SEQ ID NO: 76798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatatgcaaattccgacat

SEQ ID NO: 76799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgatatgcaaattccgac

SEQ ID NO: 76800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatgatatgcaaattccga

SEQ ID NO: 76801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttctatgatatgcaaatt

SEQ ID NO: 76802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatccaaactcatttctat

SEQ ID NO: 76803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaatccaaactcatttcta

SEQ ID NO: 76804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcatacttaaaatccaaac

SEQ ID NO: 76805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcatacttaaaatccaaa

SEQ ID NO: 76806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatcatacttaaaatccaa

SEQ ID NO: 76807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgacacatgaccgtacct

SEQ ID NO: 76808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaatgtatcacagtcatta

SEQ ID NO: 76809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagaatgtatcacagtcat

SEQ ID NO: 76810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcagaatgtatcacagtca

SEQ ID NO: 76811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgatgcatttctcagaatg

SEQ ID NO: 76812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacaaggacgaaacgtccta

SEQ ID NO: 76813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacaaggacgaaacgtcct

SEQ ID NO: 76814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggatgtttgcacaaggacga

SEQ ID NO: 76815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataagtgcaccctaggatg

SEQ ID NO: 76816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtataagtgcaccctaggat

SEQ ID NO: 76817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtttgtataagtgcaccct

SEQ ID NO: 76818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taccatctaggtttgtataa

SEQ ID NO: 76819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtgtatggtagcctatacc

SEQ ID NO: 76820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taccacatagcctaggtgta

SEQ ID NO: 76821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagcccaggagcaataggct

SEQ ID NO: 76822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagcccaggagcaataggc

SEQ ID NO: 76823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caggtttgcagcccaggagc

SEQ ID NO: 76824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacaggtttgcagcccagga

SEQ ID NO: 76825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtacagtagcccactctac

SEQ ID NO: 76826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caatattgagtacagtagcc

SEQ ID NO: 76827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctacaatattgagtacagt

SEQ ID NO: 76828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataacagttgcctacaata

SEQ ID NO: 76829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattgtataacagttgccta

SEQ ID NO: 76830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccattgtataacagttgcct

SEQ ID NO: 76831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccattgtataacagttgcc

SEQ ID NO: 76832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatacacactttccattgta

SEQ ID NO: 76833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatacacactttccattgt

SEQ ID NO: 76834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagatacacactttccattg

SEQ ID NO: 76835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctttagatacacactttcc

SEQ ID NO: 76836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtctttagatacacacttt

SEQ ID NO: 76837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtctttagatacacactt

SEQ ID NO: 76838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtctttagatacacact

SEQ ID NO: 76839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctgtctttagatacacac

SEQ ID NO: 76840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taccttttctgtctttagat

SEQ ID NO: 76841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtaccttttctgtcttta

SEQ ID NO: 76842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgtaccttttctgtcttt

SEQ ID NO: 76843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgtaccttttctgtctt

SEQ ID NO: 76844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactgtaccttttctgtct

SEQ ID NO: 76845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttactgtaccttttctgtc

SEQ ID NO: 76846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttactgtaccttttctgt

SEQ ID NO: 76847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatttttttactgtaccttt

SEQ ID NO: 76848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatactgtatttttttact

SEQ ID NO: 76849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataagattataatactgtat

SEQ ID NO: 76850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcaatagcggaccatatat

SEQ ID NO: 76851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcaatagcggaccatata

SEQ ID NO: 76852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtcaatagcggaccatat

SEQ ID NO: 76853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taccacataaggatgtttta

SEQ ID NO: 76854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cggagtattgtaccacataa

SEQ ID NO: 76855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccggagtattgtaccacata

SEQ ID NO: 76856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttccggagtattgtaccaca

SEQ ID NO: 76857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcttccggagtattgtac

SEQ ID NO: 76858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtctgcctcttccggagta

SEQ ID NO: 76859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgagtctgcctcttccgga

SEQ ID NO: 76860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgagtctgcctcttccgg

SEQ ID NO: 76861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccttactgagtctgcctctt

SEQ ID NO: 76862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgccttactgagtctgcct

SEQ ID NO: 76863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttactgccttactgagtc

SEQ ID NO: 76864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgttactgccttactgagt

SEQ ID NO: 76865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acttatgttactgccttact

SEQ ID NO: 76866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcacttatgttactgcctt

SEQ ID NO: 76867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcacttatgttactgcct

SEQ ID NO: 76868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactcacttatgttactgcc

SEQ ID NO: 76869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaacaaattttactcact

SEQ ID NO: 76870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaaacaaattttactcac

SEQ ID NO: 76871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaaaacaaattttactca

SEQ ID NO: 76872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgaatgaaaagtaagataa

SEQ ID NO: 76873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtaagtatggactggtgaa

SEQ ID NO: 76874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaggtcctaagtaagtatg

SEQ ID NO: 76875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaattagtaggtcctaagta

SEQ ID NO: 76876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacacctagaattagtaggt

SEQ ID NO: 76877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcaacacctagaattagta

SEQ ID NO: 76878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatctcctcaacacctaga

SEQ ID NO: 76879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattgtcatctcctcaacac

SEQ ID NO: 76880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attacattgtcatctcctca

SEQ ID NO: 76881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattgattacattgtcatct

SEQ ID NO: 76882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcacaaagaataccatgaaa

SEQ ID NO: 76883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaattagcacaaagaatac

SEQ ID NO: 76884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaaaattagcacaaagaa

SEQ ID NO: 76885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctactaaaaattagcacaaa

SEQ ID NO: 76886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actactaaaaattagcacaa

SEQ ID NO: 76887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactactaaaaattagcaca

SEQ ID NO: 76888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttactactaaaaattagcac

SEQ ID NO: 76889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgagaacttttactactaa

SEQ ID NO: 76890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagcaaatgacagaagagt

SEQ ID NO: 76891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacagcaaatgacagaagag

SEQ ID NO: 76892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaacaagccttaacagcaa

SEQ ID NO: 76893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggaacaagccttaacagca

SEQ ID NO: 76894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccccagtcttaggaacaag

SEQ ID NO: 76895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacaaggatagatctgcccc

SEQ ID NO: 76896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatacaaggatagatctgc

SEQ ID NO: 76897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actatacaaggatagatctg

SEQ ID NO: 76898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacatttactatacaaggat

SEQ ID NO: 76899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacatttactatacaagga

SEQ ID NO: 76900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcatttaaacatttactat

SEQ ID NO: 76901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcatttaaacatttacta

SEQ ID NO: 76902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtcatttaaacatttact

SEQ ID NO: 76903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtcatttaaacatttac

SEQ ID NO: 76904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttagtcatttaaacattta

SEQ ID NO: 76905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagagatgacaaaaggttt

SEQ ID NO: 76906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagagagatgacaaaaggtt

SEQ ID NO: 76907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtagaatagatatttaag

SEQ ID NO: 76908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagtagaatagatatttaa

SEQ ID NO: 76909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatagtagaatagatattt

SEQ ID NO: 76910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtaaaataggaagtcaggt

SEQ ID NO: 76911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acctgagtaaaataggaagt

SEQ ID NO: 76912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacctgagtaaaataggaag

SEQ ID NO: 76913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttgacctgagtaaaatag

SEQ ID NO: 76914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttgacctgagtaaaata

SEQ ID NO: 76915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatttgacctgagtaaaat

SEQ ID NO: 76916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatttgacctgagtaaaa

SEQ ID NO: 76917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaatttgacctgagtaaa

SEQ ID NO: 76918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaataatcagattttttaa

SEQ ID NO: 76919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaaagtctcccaataatca

SEQ ID NO: 76920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctccaaaagtctcccaataa

SEQ ID NO: 76921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgattactccaaaagtct

SEQ ID NO: 76922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatgattactccaaaagtc

SEQ ID NO: 76923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccatgattactccaaaag

SEQ ID NO: 76924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttccatgattactccaaaa

SEQ ID NO: 76925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttccatgattactccaaa

SEQ ID NO: 76926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagtctttcttccatgatt

SEQ ID NO: 76927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catagtctttcttccatgat

SEQ ID NO: 76928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttcatagtctttcttcca

SEQ ID NO: 76929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatccaagaatatctgatt

SEQ ID NO: 76930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaagggatagaagcaacat

SEQ ID NO: 76931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagaagggatagaagcaaca

SEQ ID NO: 76932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttaagaagggatagaagca

SEQ ID NO: 76933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acttaagaagggatagaagc

SEQ ID NO: 76934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttacttaagaagggatag

SEQ ID NO: 76935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagataattcacttacttaa

SEQ ID NO: 76936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagataattcacttactta

SEQ ID NO: 76937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggcttaaagataattcac

SEQ ID NO: 76938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatggcttaaagataattca

SEQ ID NO: 76939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggcttaatggcttaaagat

SEQ ID NO: 76940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagatgcagcagctaaggct

SEQ ID NO: 76941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagatgcagcagctaaggc

SEQ ID NO: 76942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacagatgcagcagctaagg

SEQ ID NO: 76943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacgtattttacagatgcag

SEQ ID NO: 76944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atacgtattttacagatgca

SEQ ID NO: 76945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatacgtattttacagatg

SEQ ID NO: 76946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagtaggtattcttatac

SEQ ID NO: 76947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaagtaggtattcttata

SEQ ID NO: 76948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tataaagtaggtattcttat

SEQ ID NO: 76949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaactttataaagtaggta

SEQ ID NO: 76950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaactttataaagtaggt

SEQ ID NO: 76951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttaacaactttataaagta

SEQ ID NO: 76952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactatttaacaactttata

SEQ ID NO: 76953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atactatttaacaactttat

SEQ ID NO: 76954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttatactatttaacaactt

SEQ ID NO: 76955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgcaatatcctatttata

SEQ ID NO: 76956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatgcaatatcctatttat

SEQ ID NO: 76957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtacagaatgtgtggatcac

SEQ ID NO: 76958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcagctagtacagaatgtg

SEQ ID NO: 76959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagcagctagtacagaatgt

SEQ ID NO: 76960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagcagctagtacagaatg

SEQ ID NO: 76961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagcagctagtacagaat

SEQ ID NO: 76962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttgagcagctagtacag

SEQ ID NO: 76963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgtttttgagcagctagta

SEQ ID NO: 76964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taataactcctgtttttgag

SEQ ID NO: 76965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attataataactcctgtttt

SEQ ID NO: 76966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actaattataataactcctg

SEQ ID NO: 76967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactaattataataactcct

SEQ ID NO: 76968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataatagtttaactaatta

SEQ ID NO: 76969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaattgtataatagtttaac

SEQ ID NO: 76970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctcaaattgtataatagtt

SEQ ID NO: 76971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctcaaattgtataatagt

SEQ ID NO: 76972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatctcaaattgtataatag

SEQ ID NO: 76973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatcaatagttttatctcaa

SEQ ID NO: 76974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtaagataaaatgatgatg

SEQ ID NO: 76975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagtaagataaaatgatga

SEQ ID NO: 76976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaagtaagataaaatgatg

SEQ ID NO: 76977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtcttctaagtaagataaa

SEQ ID NO: 76978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgtgtcttctaagtaaga

SEQ ID NO: 76979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctgtgtcttctaagtaag

SEQ ID NO: 76980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatctgtgtcttctaagtaa

SEQ ID NO: 76981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttatctgtgtcttctaag

SEQ ID NO: 76982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgttttatctgtgtcttct

SEQ ID NO: 76983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgttttatctgtgtcttc

SEQ ID NO: 76984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattgttttatctgtgtctt

SEQ ID NO: 76985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaggctttattgttttatc

SEQ ID NO: 76986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaactgcaaggctttattgt

SEQ ID NO: 76987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacctcaaactgcaaggctt

SEQ ID NO: 76988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacctcaaactgcaaggct

SEQ ID NO: 76989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catttgcacctcaaactgca

SEQ ID NO: 76990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctacatttgcacctcaaa

SEQ ID NO: 76991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacctacatttgcacctcaa

SEQ ID NO: 76992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacctacatttgcacctca

SEQ ID NO: 76993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgcacattttcacctacat

SEQ ID NO: 76994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgcacattttcacctaca

SEQ ID NO: 76995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgcacattttcacctac

SEQ ID NO: 76996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcatgcacattttcaccta

SEQ ID NO: 76997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggaaagcttttcatgcaca

SEQ ID NO: 76998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggaaagcttttcatgcac

SEQ ID NO: 76999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaggaaagcttttcatgca

SEQ ID NO: 77000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggagtgttttcaggaaagc

SEQ ID NO: 77001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccgaggttcaggagtgtttt

SEQ ID NO: 77002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccgaggttcaggagtgttt

SEQ ID NO: 77003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaggcccatccttcccgag

SEQ ID NO: 77004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taccaggcccatccttcccg

SEQ ID NO: 77005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actctaccaggcccatcctt

SEQ ID NO: 77006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccatactcactctaccaggc

SEQ ID NO: 77007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcccatactcactctaccag

SEQ ID NO: 77008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctctcccatactcactct

SEQ ID NO: 77009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcctctcccatactcactc

SEQ ID NO: 77010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catcttatcctctcccatac

SEQ ID NO: 77011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtatgcaaaattgcatctt

SEQ ID NO: 77012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtatgcaaaattgcatct

SEQ ID NO: 77013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgtttatgtatgcaaaat

SEQ ID NO: 77014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggatgtttatgtatgcaaaa

SEQ ID NO: 77015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggatgtttatgtatgcaaa

SEQ ID NO: 77016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatattttggatgtttatg

SEQ ID NO: 77017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaaatattttggatgttt

SEQ ID NO: 77018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attaaaatattttggatgtt

SEQ ID NO: 77019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagtaatccatccttattaa

SEQ ID NO: 77020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaagtaatccatccttatt

SEQ ID NO: 77021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggataattctaaagtaat

SEQ ID NO: 77022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaggataattctaaagtaa

SEQ ID NO: 77023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttaaaggataattctaaa

SEQ ID NO: 77024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataaatgtgaaccagcatta

SEQ ID NO: 77025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtggttgataaatgtgaac

SEQ ID NO: 77026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcagtggttgataaatgtg

SEQ ID NO: 77027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctcctcagtggttgataa

SEQ ID NO: 77028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atataattcagctcctcagt

SEQ ID NO: 77029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagagcccattcatataatt

SEQ ID NO: 77030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atagacagctccagagccca

SEQ ID NO: 77031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatacagtagtatagcagtg

SEQ ID NO: 77032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttaaatacagtagtatag

SEQ ID NO: 77033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactgtgttaaatacagtag

SEQ ID NO: 77034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atactgtgttaaatacagta

SEQ ID NO: 77035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatactgtgttaaatacag

SEQ ID NO: 77036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcattcttatactgtgtta

SEQ ID NO: 77037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcattcttatactgtgtt

SEQ ID NO: 77038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatcattcttatactgtgt

SEQ ID NO: 77039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctttcatcattcttatact

SEQ ID NO: 77040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctttcatcattcttatac

SEQ ID NO: 77041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacctttcatcattcttata

SEQ ID NO: 77042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttacctttcatcattctt

SEQ ID NO: 77043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattgctttacctttcatca

SEQ ID NO: 77044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctgcattgctttacctttc

SEQ ID NO: 77045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagtgagctacctgcattgc

SEQ ID NO: 77046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaacctagagtgagctacc

SEQ ID NO: 77047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaaacctagagtgagcta

SEQ ID NO: 77048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacaaacctagagtgagct

SEQ ID NO: 77049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctacaaacctagagtgagc

SEQ ID NO: 77050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaagttttctacaaaccta

SEQ ID NO: 77051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtaaagttttctacaaac

SEQ ID NO: 77052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaattattgtaaagttttc

SEQ ID NO: 77053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaattattgtaaagtttt

SEQ ID NO: 77054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttagaaattattgtaaagt

SEQ ID NO: 77055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttgtttagaaattattgta

SEQ ID NO: 77056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtctagttgtttagaaat

SEQ ID NO: 77057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgtctagttgtttagaaa

SEQ ID NO: 77058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatttaatgtctagttgt

SEQ ID NO: 77059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aataatttaatgtctagttg

SEQ ID NO: 77060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagccaaccatcttaataat

SEQ ID NO: 77061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagccaaccatcttaataa

SEQ ID NO: 77062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaagccaaccatcttaat

SEQ ID NO: 77063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgaagccaaccatcttaa

SEQ ID NO: 77064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcttcttgaagccaacca

SEQ ID NO: 77065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatcttcttgaagccaacc

SEQ ID NO: 77066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accttaaatcttcttgaagc

SEQ ID NO: 77067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagatgttaaccttaaatct

SEQ ID NO: 77068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagatgttaaccttaaatc

SEQ ID NO: 77069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagatgttaaccttaaat

SEQ ID NO: 77070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaagatgttaaccttaaa

SEQ ID NO: 77071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccatttttaaagatgttaac

SEQ ID NO: 77072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccatttttaaagatgttaa

SEQ ID NO: 77073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccatttttaaagatgtta

SEQ ID NO: 77074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcccatttttaaagatgtt

SEQ ID NO: 77075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcccatttttaaagatgt

SEQ ID NO: 77076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttttcccatttttaaa

SEQ ID NO: 77077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattcaattttttcccattt

SEQ ID NO: 77078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcattcaattttttcccatt

SEQ ID NO: 77079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcattcaattttttcccat

SEQ ID NO: 77080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgcattcaattttttccc

SEQ ID NO: 77081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttgcattcaattttttcc

SEQ ID NO: 77082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttgcattcaattttttc

SEQ ID NO: 77083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttgcattcaatttttt

SEQ ID NO: 77084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttctttgcattcaatt

SEQ ID NO: 77085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttttctttgcattcaat

SEQ ID NO: 77086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatatgcacaagcaatattt

SEQ ID NO: 77087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatatgcacaagcaatatt

SEQ ID NO: 77088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaatatgcacaagcaatat

SEQ ID NO: 77089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaatatgcacaagcaata

SEQ ID NO: 77090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaatcatcccacttttgaa

SEQ ID NO: 77091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaatcatcccacttttga

SEQ ID NO: 77092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagaatcatcccacttttg

SEQ ID NO: 77093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttcagaatcatcccact

SEQ ID NO: 77094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctttcagaatcatcccac

SEQ ID NO: 77095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatctttcagaatcatccca

SEQ ID NO: 77096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttatctttcagaatcatcc

SEQ ID NO: 77097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attctttatctttcagaatc

SEQ ID NO: 77098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgcccggccgtgattcattc

SEQ ID NO: 77099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggcgtgagccactgcgcc

SEQ ID NO: 77100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcattacaggcgtgagccac

SEQ ID NO: 77101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaagtgctggcattacag

SEQ ID NO: 77102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gacctcccaaagtgctggca

SEQ ID NO: 77103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccgcctcgacctcccaaag

SEQ ID NO: 77104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gtgatctgcccgcctcgacc

SEQ ID NO: 77105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctcgtgatctgcccgcct

SEQ ID NO: 77106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgacctcgtgatctgcccg

SEQ ID NO: 77107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gatctcctgacctcgtgatc

SEQ ID NO: 77108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccaggatggtctcgatctc

SEQ ID NO: 77109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttagccaggatggtctcg

SEQ ID NO: 77110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgtgttagccaggatggt

SEQ ID NO: 77111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgtgttagccaggatgg

SEQ ID NO: 77112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagagacggggtttcattg

SEQ ID NO: 77113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagagacggggtttcatt

SEQ ID NO: 77114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagagacggggtttcat

SEQ ID NO: 77115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtagagacggggtttca

SEQ ID NO: 77116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttagtagagacgggg

SEQ ID NO: 77117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttttagtagagacggg

SEQ ID NO: 77118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatttttagtagagacgg

SEQ ID NO: 77119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtatttttagtagagacg

SEQ ID NO: 77120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtatttttagtagagac

SEQ ID NO: 77121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgtatttttagtagaga

SEQ ID NO: 77122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttttttgtatttttagtag

SEQ ID NO: 77123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caggtgcccgccaccacgcc

SEQ ID NO: 77124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggactacaggtgcccgccac

SEQ ID NO: 77125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaagtagctgggactacag

SEQ ID NO: 77126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctgccaagtagctggga

SEQ ID NO: 77127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagcctgccaagtagct

SEQ ID NO: 77128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcctcagcctgccaagta

SEQ ID NO: 77129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctgcctcagcctgccaag

SEQ ID NO: 77130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaccattctcctgcctcag

SEQ ID NO: 77131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccgggttcacaccattctcc

SEQ ID NO: 77132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgcctcccgggttcacacca

SEQ ID NO: 77133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taagctccgcctcccgggtt

SEQ ID NO: 77134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgtaagctccgcctcccg

SEQ ID NO: 77135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggctcactgtaagctccgcc

SEQ ID NO: 77136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctcggctcactgtaagctc

SEQ ID NO: 77137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatgcagtgtcgctatctc

SEQ ID NO: 77138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggctggaatgcagtgtcgct

SEQ ID NO: 77139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcgcctaggctggaatgcag

SEQ ID NO: 77140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtcgcctaggctggaatgc

SEQ ID NO: 77141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actctgtcgcctaggctgga

SEQ ID NO: 77142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatggagtctcactctgtc

SEQ ID NO: 77143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagatggagtctcactctgt

SEQ ID NO: 77144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagatggagtctcactctg

SEQ ID NO: 77145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagatggagtctcactct

SEQ ID NO: 77146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagatggagtctcactc

SEQ ID NO: 77147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgagatggagtctcact

SEQ ID NO: 77148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgagatggagtctcac

SEQ ID NO: 77149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgagatggagtctca

SEQ ID NO: 77150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttgagatggagtctc

SEQ ID NO: 77151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttgagatggagtct

SEQ ID NO: 77152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttgagatggagtc

SEQ ID NO: 77153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttgagatggagt

SEQ ID NO: 77154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttgagatggag

SEQ ID NO: 77155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttgagatgga

SEQ ID NO: 77156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttgagatgg

SEQ ID NO: 77157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttgagatg

SEQ ID NO: 77158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttgagat

SEQ ID NO: 77159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttttgaga

SEQ ID NO: 77160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttgag

SEQ ID NO: 77161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttttttga

SEQ ID NO: 77162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttg

SEQ ID NO: 77163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 77164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 77165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 77166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 77167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 77168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 77169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 77170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 77171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 77172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttttttttttttttttt

SEQ ID NO: 77173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttttttttttttttttt

SEQ ID NO: 77174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtcatggttcttttttttt

SEQ ID NO: 77175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgagtcatggttctttttt

SEQ ID NO: 77176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtagtgggattactgagtca

SEQ ID NO: 77177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtatatacctagtagtggg

SEQ ID NO: 77178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagtatatacctagtagtg

SEQ ID NO: 77179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttctcagtatatacctag

SEQ ID NO: 77180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagttctcagtatataccta

SEQ ID NO: 77181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagttctcagtatatacct

SEQ ID NO: 77182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttcagttctcagtata

SEQ ID NO: 77183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattttcagttctcagtat

SEQ ID NO: 77184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaattttcagttctcagta

SEQ ID NO: 77185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggaaatacattttcaattt

SEQ ID NO: 77186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggaaatacattttcaatt

SEQ ID NO: 77187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtggaaatacattttcaat

SEQ ID NO: 77188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtggaaatacattttcaa

SEQ ID NO: 77189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtacaagtttttgtggaa

SEQ ID NO: 77190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaacattcatgtacaagtt

SEQ ID NO: 77191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtaaacattcatgtacaa

SEQ ID NO: 77192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatgcataatgttgctgta

SEQ ID NO: 77193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttataatgcataatgttgc

SEQ ID NO: 77194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttataatgcataatgttg

SEQ ID NO: 77195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggttataatgcataatgtt

SEQ ID NO: 77196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggttataatgcataatgt

SEQ ID NO: 77197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgtcttttggttataatgca

SEQ ID NO: 77198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccgtcttttggttataatgc

SEQ ID NO: 77199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttccgtcttttggttataa

SEQ ID NO: 77200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggttatttccgtcttttggt

SEQ ID NO: 77201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggttatttccgtcttttgg

SEQ ID NO: 77202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggacatttgggttatttc

SEQ ID NO: 77203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcagttgatggacatttgg

SEQ ID NO: 77204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacattcatcagttgatgga

SEQ ID NO: 77205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacattcatcagttgatgg

SEQ ID NO: 77206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttatacattcatcagttga

SEQ ID NO: 77207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttatacattcatcagttg

SEQ ID NO: 77208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttatacattcatcagtt

SEQ ID NO: 77209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattttgtttatacattcat

SEQ ID NO: 77210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatgtatatgctatattttg

SEQ ID NO: 77211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgtatgtatatgctatat

SEQ ID NO: 77212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgtatgtatatgctata

SEQ ID NO: 77213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgatatttcattgtatgt

SEQ ID NO: 77214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaatgatatttcattgta

SEQ ID NO: 77215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgctaaatgatatttcatt

SEQ ID NO: 77216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgctaaatgatatttcat

SEQ ID NO: 77217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgctaaatgatatttca

SEQ ID NO: 77218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattgctaaatgatatttc

SEQ ID NO: 77219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttattgctaaatgatattt

SEQ ID NO: 77220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttattgctaaatgatat

SEQ ID NO: 77221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttattgctaaatgata

SEQ ID NO: 77222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttctttttattgctaaat

SEQ ID NO: 77223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catttctttttattgctaaa

SEQ ID NO: 77224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcttcatttctttttattg

SEQ ID NO: 77225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccatggtatagtatgtatc

SEQ ID NO: 77226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccatggtatagtatgtat

SEQ ID NO: 77227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatttatccatggtatag

SEQ ID NO: 77228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaatttatccatggtata

SEQ ID NO: 77229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaaatttatccatggtat

SEQ ID NO: 77230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcataatgttttcaaaattt

SEQ ID NO: 77231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacctagcataatgttttca

SEQ ID NO: 77232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acacctagcataatgttttc

SEQ ID NO: 77233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacacctagcataatgttt

SEQ ID NO: 77234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttacacctagcataatgtt

SEQ ID NO: 77235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttcttacacctagcataa

SEQ ID NO: 77236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatctggcttcttacaccta

SEQ ID NO: 77237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatctggcttcttacacct

SEQ ID NO: 77238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatctggcttcttacacc

SEQ ID NO: 77239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtatctggcttcttacac

SEQ ID NO: 77240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgtatctggcttcttaca

SEQ ID NO: 77241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatacatggaagcatataa

SEQ ID NO: 77242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatatacatggaagcatata

SEQ ID NO: 77243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagatttaatatacatggaa

SEQ ID NO: 77244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtagatttaatatacatgg

SEQ ID NO: 77245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccactctgtagatttaata

SEQ ID NO: 77246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acccactctgtagatttaat

SEQ ID NO: 77247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggatttacccactctgtag

SEQ ID NO: 77248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tccctagggatttacccact

SEQ ID NO: 77249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtccctagggatttaccca

SEQ ID NO: 77250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtccctagggatttaccc

SEQ ID NO: 77251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgtccctagggatttacc

SEQ ID NO: 77252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttctgtccctagggattt

SEQ ID NO: 77253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atctactttctgtccctagg

SEQ ID NO: 77254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaaccactaatctactttc

SEQ ID NO: 77255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccagcccctggcaaccacta

SEQ ID NO: 77256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccagcccctggcaaccac

SEQ ID NO: 77257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcccagcccctggcaacca

SEQ ID NO: 77258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcccagcccctggcaacc

SEQ ID NO: 77259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctcccagcccctggcaac

SEQ ID NO: 77260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttttctcccagcccctgg

SEQ ID NO: 77261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccttttctcccagcccctg

SEQ ID NO: 77262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccatttcccttttctccca

SEQ ID NO: 77263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagtcattccccatttccc

SEQ ID NO: 77264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaccaagaaacccagggcc

SEQ ID NO: 77265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccaccaagaaacccagggc

SEQ ID NO: 77266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcccaccaagaaacccaggg

SEQ ID NO: 77267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctttcccaccaagaaacc

SEQ ID NO: 77268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catctttcccaccaagaaac

SEQ ID NO: 77269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatctttcccaccaagaaa

SEQ ID NO: 77270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatattttcatctttccca

SEQ ID NO: 77271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatattttcatctttccc

SEQ ID NO: 77272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttaaaatattttcatctt

SEQ ID NO: 77273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctaatttaaaatattttca

SEQ ID NO: 77274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcaacgatcgccactatct

SEQ ID NO: 77275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagttgtgcaacgatcgcc

SEQ ID NO: 77276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactcagagttgtgcaacga

SEQ ID NO: 77277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactatactcagagttgtgc

SEQ ID NO: 77278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaactatactcagagttgtg

SEQ ID NO: 77279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaactatactcagagttgt

SEQ ID NO: 77280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaactatactcagagttg

SEQ ID NO: 77281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaactatactcagagtt

SEQ ID NO: 77282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attttttaaactatactcag

SEQ ID NO: 77283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tataactcattttttaaact

SEQ ID NO: 77284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactgtataactcatttttt

SEQ ID NO: 77285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaactgtataactcattttt

SEQ ID NO: 77286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaactgtataactcatttt

SEQ ID NO: 77287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaactgtataactcattt

SEQ ID NO: 77288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaactgtataactcatt

SEQ ID NO: 77289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaactgtataactcat

SEQ ID NO: 77290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttaaactgtataactca

SEQ ID NO: 77291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttttttaaactgtataac

SEQ ID NO: 77292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgccacaaaattcctttt

SEQ ID NO: 77293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgccacaaaattccttt

SEQ ID NO: 77294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaataatttatatgccac

SEQ ID NO: 77295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaggaataatttatatgc

SEQ ID NO: 77296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgaggaataatttatatg

SEQ ID NO: 77297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaataggtttattgaggaa

SEQ ID NO: 77298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaataggtttattgagga

SEQ ID NO: 77299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaataggtttattgagg

SEQ ID NO: 77300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaaataggtttattgag

SEQ ID NO: 77301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttttaaaaataggtttat

SEQ ID NO: 77302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattcccttttaaaaatagg

SEQ ID NO: 77303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgctgcattcccttttaaaa

SEQ ID NO: 77304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccgttatgctgcattccctt

SEQ ID NO: 77305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccgttatgctgcattccct

SEQ ID NO: 77306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgccgttatgctgcattccc

SEQ ID NO: 77307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccccacccacaacctttgc

SEQ ID NO: 77308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acccccacccacaacctttg

SEQ ID NO: 77309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttacccccacccacaacct

SEQ ID NO: 77310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttacccccacccacaacc

SEQ ID NO: 77311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcatttatttacccccaccc

SEQ ID NO: 77312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgataagttggcatttatt

SEQ ID NO: 77313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgataagttggcatttat

SEQ ID NO: 77314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgataagttggcattta

SEQ ID NO: 77315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccatacgtattttagtgat

SEQ ID NO: 77316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccatacgtattttagtga

SEQ ID NO: 77317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccccatacgtattttagtg

SEQ ID NO: 77318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttccccatacgtatttt

SEQ ID NO: 77319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattttccccatacgtattt

SEQ ID NO: 77320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattttccccatacgtatt

SEQ ID NO: 77321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcaattttcattttcccc

SEQ ID NO: 77322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatatcaattttcattttc

SEQ ID NO: 77323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttatatcaattttcatttt

SEQ ID NO: 77324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttatatcaattttcattt

SEQ ID NO: 77325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttatatcaattttcatt

SEQ ID NO: 77326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatttttgttatatcaattt

SEQ ID NO: 77327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtatttttgttatatcaat

SEQ ID NO: 77328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatcaattctgtatttttg

SEQ ID NO: 77329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatatcaattctgtattttt

SEQ ID NO: 77330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatttaatatcaattctgta

SEQ ID NO: 77331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attagatttaatatcaattc

SEQ ID NO: 77332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattagatttaatatcaatt

SEQ ID NO: 77333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acccagaatcttcattagat

SEQ ID NO: 77334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacccagaatcttcattaga

SEQ ID NO: 77335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaacttcacccagaatctt

SEQ ID NO: 77336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaacttcacccagaatct

SEQ ID NO: 77337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttaaaaacttcacccaga

SEQ ID NO: 77338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaattaatttaaaaacttc

SEQ ID NO: 77339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaaattaatttaaaaactt

SEQ ID NO: 77340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcttgaaaattaatttaaa

SEQ ID NO: 77341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattaatcttgaaaattaat

SEQ ID NO: 77342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctacattaatcttgaaaatt

SEQ ID NO: 77343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctacattaatcttgaaaat

SEQ ID NO: 77344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctacattaatcttgaaaa

SEQ ID NO: 77345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttgctacattaatcttga

SEQ ID NO: 77346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattttgctacattaatctt

SEQ ID NO: 77347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattttgctacattaatct

SEQ ID NO: 77348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctattttgctacattaatc

SEQ ID NO: 77349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctattttgctacattaat

SEQ ID NO: 77350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctattttgctacattaa

SEQ ID NO: 77351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctattttgctacatta

SEQ ID NO: 77352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttctattttgctacatt

SEQ ID NO: 77353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttctattttgctacat

SEQ ID NO: 77354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatttttttttctattttg

SEQ ID NO: 77355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcaagggcagaattaccat

SEQ ID NO: 77356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagcaagggcagaattacc

SEQ ID NO: 77357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgagcaagggcagaattac

SEQ ID NO: 77358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgagcaagggcagaatta

SEQ ID NO: 77359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctttctgagcaagggcaga

SEQ ID NO: 77360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcataagttgtctttctgag

SEQ ID NO: 77361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cataggcccaagccatacac

SEQ ID NO: 77362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccataggcccaagccataca

SEQ ID NO: 77363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttccataggcccaagcca

SEQ ID NO: 77364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacttccataggcccaagcc

SEQ ID NO: 77365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcacttccataggcccaag

SEQ ID NO: 77366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggatatactcttcacttcc

SEQ ID NO: 77367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gttggggatatactcttcac

SEQ ID NO: 77368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgttggggatatactcttca

SEQ ID NO: 77369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccttcgttggggatatact

SEQ ID NO: 77370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcccttcgttggggatatac

SEQ ID NO: 77371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgcccttcgttggggata

SEQ ID NO: 77372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattatttgcccttcgttgg

SEQ ID NO: 77373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagttgcattatttgccct

SEQ ID NO: 77374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagagttgcattatttgcc

SEQ ID NO: 77375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcagagttgcattatttgc

SEQ ID NO: 77376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcagagttgcattatttg

SEQ ID NO: 77377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttttctcagagttgcatta

SEQ ID NO: 77378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactagttttctcagagttg

SEQ ID NO: 77379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcccctgcactagttttct

SEQ ID NO: 77380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccagtcctgatcccctgca

SEQ ID NO: 77381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcccagtcctgatcccctg

SEQ ID NO: 77382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccagagtgtagagtatcatg

SEQ ID NO: 77383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccagagtgtagagtatcat

SEQ ID NO: 77384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catttgccagagtgtagagt

SEQ ID NO: 77385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagaactacatttgccaga

SEQ ID NO: 77386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgagaactacatttgccag

SEQ ID NO: 77387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtgagaactacatttgcc

SEQ ID NO: 77388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgtgagaactacatttgc

SEQ ID NO: 77389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgtgagaactacatttg

SEQ ID NO: 77390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttcttgtgagaactacat

SEQ ID NO: 77391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagctgttttcttgtgagaa

SEQ ID NO: 77392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctacagctgttttcttgt

SEQ ID NO: 77393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catctacagctgttttcttg

SEQ ID NO: 77394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttcatctacagctgttttc

SEQ ID NO: 77395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctccttcatctacagctgt

SEQ ID NO: 77396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatctccttcatctacagc

SEQ ID NO: 77397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctatctccttcatctacag

SEQ ID NO: 77398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctatctccttcatctaca

SEQ ID NO: 77399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acaggaattttcctatctcc

SEQ ID NO: 77400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaacaggaattttcctatc

SEQ ID NO: 77401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actactaacaggaattttcc

SEQ ID NO: 77402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cactactaacaggaattttc

SEQ ID NO: 77403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccttcactactaacaggaa

SEQ ID NO: 77404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaaaccgcaatattggcc

SEQ ID NO: 77405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaaaaccgcaatattggc

SEQ ID NO: 77406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaaaaaccgcaatattgg

SEQ ID NO: 77407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagagaaagttttgaaaaa

SEQ ID NO: 77408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatagagaaagttttgaaaa

SEQ ID NO: 77409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatttaatagagaaagttt

SEQ ID NO: 77410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacatttaatagagaaagtt

SEQ ID NO: 77411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatttgacatttaatagag

SEQ ID NO: 77412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatatttgacatttaatag

SEQ ID NO: 77413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaatatttgacatttaata

SEQ ID NO: 77414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaatatttgacatttaat

SEQ ID NO: 77415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctaatatttgacatttaa

SEQ ID NO: 77416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttctaatatttgacatt

SEQ ID NO: 77417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgtttttctaatatttgac

SEQ ID NO: 77418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcctgtttttctaatattt

SEQ ID NO: 77419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctcctgtttttctaatatt

SEQ ID NO: 77420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcctcctgtttttctaata

SEQ ID NO: 77421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttcctcctgtttttctaa

SEQ ID NO: 77422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaacaggatattctcttcct

SEQ ID NO: 77423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggctaaaacaggatattctc

SEQ ID NO: 77424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattgggctaaaacaggata

SEQ ID NO: 77425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggttatattgggctaaaac

SEQ ID NO: 77426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggagaaatatactgtggtt

SEQ ID NO: 77427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgtgcagtattatggaga

SEQ ID NO: 77428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtgcacagtgtgtagcta

SEQ ID NO: 77429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagatgaaagtggggttcat

SEQ ID NO: 77430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctacagatgaaagtggggtt

SEQ ID NO: 77431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgctgctacagatgaaagtg

SEQ ID NO: 77432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgctgctacagatgaaagt

SEQ ID NO: 77433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgctgctacagatgaaag

SEQ ID NO: 77434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatgctgctacagatgaaa

SEQ ID NO: 77435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatgctgctacagatgaa

SEQ ID NO: 77436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttatgctgctacagatga

SEQ ID NO: 77437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcaaacacttttttatgct

SEQ ID NO: 77438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgctcatcaaacacttttt

SEQ ID NO: 77439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgctcatcaaacactttt

SEQ ID NO: 77440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatgctcatcaaacacttt

SEQ ID NO: 77441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttgatgctcatcaaacac

SEQ ID NO: 77442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctactttgatgctcatcaa

SEQ ID NO: 77443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtctactttgatgctcat

SEQ ID NO: 77444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgttgctgtctactttgat

SEQ ID NO: 77445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgttgctgtctactttga

SEQ ID NO: 77446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtgttgctgtctactttg

SEQ ID NO: 77447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttggtgttgctgtctact

SEQ ID NO: 77448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttggtgttgctgtctac

SEQ ID NO: 77449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagatttcctttggtgttgc

SEQ ID NO: 77450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagatttcctttggtgttg

SEQ ID NO: 77451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaaacatacaatttgtaga

SEQ ID NO: 77452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgaaaaacatacaatttgt

SEQ ID NO: 77453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgctgaaaaacatacaatt

SEQ ID NO: 77454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acctcctgctgaaaaacata

SEQ ID NO: 77455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctcacctcctgctgaaaaa

SEQ ID NO: 77456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acccactgtctcacctcctg

SEQ ID NO: 77457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaatcaaataaattaaccc

SEQ ID NO: 77458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaattcacaatcaaataaa

SEQ ID NO: 77459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaattcacaatcaaataa

SEQ ID NO: 77460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccaaattcacaatcaaata

SEQ ID NO: 77461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgaaatgcctttccaaattc

SEQ ID NO: 77462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccgaaatgcctttccaaatt

SEQ ID NO: 77463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccgaaatgcctttccaaat

SEQ ID NO: 77464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagcaaagtattttccgaaa

SEQ ID NO: 77465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgcctatagcaaagtattt

SEQ ID NO: 77466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggtgcctatagcaaagtat

SEQ ID NO: 77467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggtgcctatagcaaagta

SEQ ID NO: 77468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctggtgcctatagcaaagt

SEQ ID NO: 77469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagcattttctggtgccta

SEQ ID NO: 77470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcataatctaaaagcattt

SEQ ID NO: 77471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacagagaacctgagcataa

SEQ ID NO: 77472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatggtaaaggcaatctac

SEQ ID NO: 77473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagatcaaggaattataat

SEQ ID NO: 77474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagatcaaggaattataa

SEQ ID NO: 77475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaatatttaaaagatcaag

SEQ ID NO: 77476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggcaaatgaattggcaata

SEQ ID NO: 77477 - DNA, 20 bp, synthetic construct
  source 1..20: mol_type = other DNA; note = Description ofArtificial Sequence: Synthetic oligonucleotide; note = Target: SCN9A; (-) strand; PAM type: YTN; PAM sequence: TTG
atagatcatgagaaagtgct

SEQ ID NO: 77478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttgatagatcatgagaaag

SEQ ID NO: 77479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttgatagatcatgagaaa

SEQ ID NO: 77480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacaaagagtgacaagaact

SEQ ID NO: 77481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agctgtacaaagagtgacaa

SEQ ID NO: 77482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagctgtacaaagagtgaca

SEQ ID NO: 77483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgataatgaatgcccatgg

SEQ ID NO: 77484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcactgatgataatgaatg

SEQ ID NO: 77485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaggttaggcactgatgat

SEQ ID NO: 77486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgccaggttaggcactgatg

SEQ ID NO: 77487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggttctgccaggttaggca

SEQ ID NO: 77488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgtagactgtggttctgc

SEQ ID NO: 77489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtagccagcatggaaaagac

SEQ ID NO: 77490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtagccagcatggaaaaga

SEQ ID NO: 77491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agccatttggtagccagcat

SEQ ID NO: 77492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caccaacattcagccatttg

SEQ ID NO: 77493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccaccaacattcagccatt

SEQ ID NO: 77494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccaccaacattcagccat

SEQ ID NO: 77495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagagtttctccaccaaca

SEQ ID NO: 77496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttgtgagagtttctccacc

SEQ ID NO: 77497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttgtgagagtttctccac

SEQ ID NO: 77498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttggttgtgagagtttct

SEQ ID NO: 77499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatataaccattcacttgg

SEQ ID NO: 77500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaatataaccattcacttg

SEQ ID NO: 77501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttaaaatataaccattcac

SEQ ID NO: 77502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acttaaaatataaccattca

SEQ ID NO: 77503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttacttaaaatataaccat

SEQ ID NO: 77504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagattacttacttaaaata

SEQ ID NO: 77505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgttggagattacttactt

SEQ ID NO: 77506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgttggagattacttact

SEQ ID NO: 77507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtgcaaatttgatgttgga

SEQ ID NO: 77508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtgcaaatttgatgttgg

SEQ ID NO: 77509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagtgcaaatttgatgttg

SEQ ID NO: 77510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtattttgagtgcaaatt

SEQ ID NO: 77511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgtattttgagtgcaaat

SEQ ID NO: 77512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatatggtcatatcaggg

SEQ ID NO: 77513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgagaatgcattatatata

SEQ ID NO: 77514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgagaatgcattatatat

SEQ ID NO: 77515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagatgatttgatgagaatg

SEQ ID NO: 77516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacagatgatttgatgagaa

SEQ ID NO: 77517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agagtgcaaatgaggaagag

SEQ ID NO: 77518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctgagagtgcaaatgagga

SEQ ID NO: 77519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagtataagatgggatcat

SEQ ID NO: 77520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcaaagtataagatgggat

SEQ ID NO: 77521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcaaagtataagatggga

SEQ ID NO: 77522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcctcaaagtataagatg

SEQ ID NO: 77523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcctcaaagtataagat

SEQ ID NO: 77524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttcctcaaagtataaga

SEQ ID NO: 77525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttcctcaaagtataag

SEQ ID NO: 77526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaacccaatggtttttattt

SEQ ID NO: 77527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttcaaacccaatggtttt

SEQ ID NO: 77528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaaagatgattgagttca

SEQ ID NO: 77529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagagttatcaaaagatgat

SEQ ID NO: 77530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caccgaaacaggaggaaaga

SEQ ID NO: 77531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gtgaaagtgaaagagtaaag

SEQ ID NO: 77532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggagagagagggagaagtc

SEQ ID NO: 77533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatgaatcaattcaggag

SEQ ID NO: 77534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgataatgaatgagtagtt

SEQ ID NO: 77535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctagtgataatgaatgagta

SEQ ID NO: 77536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctagtgataatgaatgagt

SEQ ID NO: 77537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctagtgataatgaatgag

SEQ ID NO: 77538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatggatgttttgctagtga

SEQ ID NO: 77539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatggatgttttgctagtg

SEQ ID NO: 77540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatggatgttttgctagt

SEQ ID NO: 77541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtatggatgttttgctag

SEQ ID NO: 77542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaatatatgggtttttg

SEQ ID NO: 77543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaaatatatgggttttt

SEQ ID NO: 77544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcatttaaaaaaatatatgg

SEQ ID NO: 77545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaagggaagcagaataatg

SEQ ID NO: 77546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctataaagggaagcagaat

SEQ ID NO: 77547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctataaagggaagcagaa

SEQ ID NO: 77548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaagaaatttggctataaa

SEQ ID NO: 77549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccaagaaatttggctata

SEQ ID NO: 77550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggtaagaataaggtgcat

SEQ ID NO: 77551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtaagtggtagggttcaag

SEQ ID NO: 77552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtaagtggtagggttcaa

SEQ ID NO: 77553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaaatttgggtaagtggt

SEQ ID NO: 77554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagaaaatttgggtaagtgg

SEQ ID NO: 77555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgagaaaatttgggtaagt

SEQ ID NO: 77556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgagaaaatttgggtaag

SEQ ID NO: 77557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtaacagggaagtcatcag

SEQ ID NO: 77558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggttaagtaacagggaagtc

SEQ ID NO: 77559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caagatcaaggagtaaggat

SEQ ID NO: 77560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtagaatcatgctgcaaga

SEQ ID NO: 77561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgtagaatcatgctgcaag

SEQ ID NO: 77562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagaaacagatgtgcttgtg

SEQ ID NO: 77563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggtagaaaagaggacccag

SEQ ID NO: 77564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaattcaggtagaaaagagg

SEQ ID NO: 77565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaattcaggtagaaaagag

SEQ ID NO: 77566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acatttagaattcaggtaga

SEQ ID NO: 77567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgacatttagaattcaggta

SEQ ID NO: 77568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caactctgacatttagaatt

SEQ ID NO: 77569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtaccaagatctacaactct

SEQ ID NO: 77570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagcaatctggtaccaagat

SEQ ID NO: 77571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagcaatctggtaccaaga

SEQ ID NO: 77572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtatttaaagcaatctggta

SEQ ID NO: 77573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtagatagagaatgggaaa

SEQ ID NO: 77574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtagatagagaatgggaa

SEQ ID NO: 77575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtagatagagaatggga

SEQ ID NO: 77576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagtagatagagaatggg

SEQ ID NO: 77577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatttttaagtagatagag

SEQ ID NO: 77578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacatccctgatatttttaa

SEQ ID NO: 77579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaacatccctgatattttt

SEQ ID NO: 77580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctctgaacatccctgatat

SEQ ID NO: 77581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacctctgaacatccctgat

SEQ ID NO: 77582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagagcaatcagcaaaaaga

SEQ ID NO: 77583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagataaattccagagcaat

SEQ ID NO: 77584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggagataaattccagagcaa

SEQ ID NO: 77585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtttggagataaattccag

SEQ ID NO: 77586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgagtttggagataaattc

SEQ ID NO: 77587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtatagaaatcagagggcc

SEQ ID NO: 77588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtatagaaatcagagggc

SEQ ID NO: 77589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagatttaagtatagaaatc

SEQ ID NO: 77590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatgtccaggtggatatat

SEQ ID NO: 77591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagatgtccaggtggatata

SEQ ID NO: 77592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagatgtccaggtggatat

SEQ ID NO: 77593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgagatgcctttgagat

SEQ ID NO: 77594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaattaaaatgagatgcctt

SEQ ID NO: 77595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctaaaattaaaatgagatg

SEQ ID NO: 77596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctagctaaaattaaaatga

SEQ ID NO: 77597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttagctagctaaaattaaaa

SEQ ID NO: 77598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagaggaaggtcactattag

SEQ ID NO: 77599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagaggaaggtcactatta

SEQ ID NO: 77600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaggaaatggtggacaca

SEQ ID NO: 77601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatgggtggtgatggttaat

SEQ ID NO: 77602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caataactggatgggtggtg

SEQ ID NO: 77603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctgcaataactggatgggt

SEQ ID NO: 77604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggctgcaataactggatgg

SEQ ID NO: 77605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggctgcaataactggatg

SEQ ID NO: 77606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtttctggctgcaataact

SEQ ID NO: 77607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagtttctggctgcaataa

SEQ ID NO: 77608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcagtttctggctgcaata

SEQ ID NO: 77609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggatgacttctcagtttct

SEQ ID NO: 77610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaagacaggaagcattga

SEQ ID NO: 77611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggattaaagaagacagga

SEQ ID NO: 77612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgatggattaaagaagaca

SEQ ID NO: 77613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgatggattaaagaagac

SEQ ID NO: 77614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagagcttgctgatggatta

SEQ ID NO: 77615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacatacaaagtctgtagag

SEQ ID NO: 77616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagtgatggcagagaaatga

SEQ ID NO: 77617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctagagtgatggcagaga

SEQ ID NO: 77618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catctagagtgatggcagag

SEQ ID NO: 77619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcaagagaaaataaaggtt

SEQ ID NO: 77620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctaggcaagagaaaataa

SEQ ID NO: 77621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatctaggcaagagaaaat

SEQ ID NO: 77622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcatctaggcaagagaaa

SEQ ID NO: 77623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctcatctaggcaagagaa

SEQ ID NO: 77624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttctctcatctaggcaaga

SEQ ID NO: 77625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggttgcttctctcatcta

SEQ ID NO: 77626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcaagggtagatggtagat

SEQ ID NO: 77627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attgagcaagggtagatggt

SEQ ID NO: 77628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcacaactgattgagcaag

SEQ ID NO: 77629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgcacaactgattgagcaa

SEQ ID NO: 77630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttgtgcacaactgattga

SEQ ID NO: 77631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctgtcttgtgcacaactga

SEQ ID NO: 77632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtctgtcttgtgcacaac

SEQ ID NO: 77633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgctgtctgtcttgtgcac

SEQ ID NO: 77634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgctgtctgtcttgtgca

SEQ ID NO: 77635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgctgtctgtcttgtgc

SEQ ID NO: 77636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattgctgtctgtcttgtg

SEQ ID NO: 77637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgcagtcatttttattgc

SEQ ID NO: 77638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgcagtcatttttattg

SEQ ID NO: 77639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatgcagtcatttttatt

SEQ ID NO: 77640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaaatgcagtcattttt

SEQ ID NO: 77641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttaaatgcagtcatttt

SEQ ID NO: 77642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttaaatgcagtcattt

SEQ ID NO: 77643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattttattttaaatgcagt

SEQ ID NO: 77644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattttattttaaatgcag

SEQ ID NO: 77645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcccatgggaaggagtttg

SEQ ID NO: 77646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcccatgggaaggagttt

SEQ ID NO: 77647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaagagaaaggaagaatgg

SEQ ID NO: 77648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaagagaaaggaagaatg

SEQ ID NO: 77649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaatggaaaaacagcagc

SEQ ID NO: 77650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagaatggaaaaacagcag

SEQ ID NO: 77651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aataaagggagggtatgggt

SEQ ID NO: 77652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagaaatagcatgggcaaa

SEQ ID NO: 77653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattaggagaaatagcatgg

SEQ ID NO: 77654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caattaggagaaatagcatg

SEQ ID NO: 77655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttcaattaggagaaatagc

SEQ ID NO: 77656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgtggggggtgctgcttc

SEQ ID NO: 77657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgtgggtgtgagtctatg

SEQ ID NO: 77658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtgtgggtgtgagtctat

SEQ ID NO: 77659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagatagtaagaagccata

SEQ ID NO: 77660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatctaaaagatagtaaga

SEQ ID NO: 77661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agctgagatctaaaagatag

SEQ ID NO: 77662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagctgagatctaaaagata

SEQ ID NO: 77663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtgatggcatttaagctg

SEQ ID NO: 77664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaggtgatggcatttaagc

SEQ ID NO: 77665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatgagaagacatctctgag

SEQ ID NO: 77666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatatcaactagatgagaa

SEQ ID NO: 77667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggtgctgagatatcaacta

SEQ ID NO: 77668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taataaatgccatgcaaagg

SEQ ID NO: 77669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagttataataaatgccatg

SEQ ID NO: 77670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatatctcaagttataat

SEQ ID NO: 77671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agggggaacagacaaataaa

SEQ ID NO: 77672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagggggaacagacaaataa

SEQ ID NO: 77673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgggaatgaaaaaaaatgt

SEQ ID NO: 77674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatctagtgggaatgaaaa

SEQ ID NO: 77675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcatctagtgggaatgaaa

SEQ ID NO: 77676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagagcttatcatctagtg

SEQ ID NO: 77677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacagagcttatcatctagt

SEQ ID NO: 77678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcacagagcttatcatctag

SEQ ID NO: 77679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttcacagagcttatcatc

SEQ ID NO: 77680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctttcacagagcttatcat

SEQ ID NO: 77681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcccttgctttcacagagc

SEQ ID NO: 77682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagcaataaatgatagcctc

SEQ ID NO: 77683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agctatagcaataaatgata

SEQ ID NO: 77684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgagctatagcaataaat

SEQ ID NO: 77685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctgagctatagcaataaa

SEQ ID NO: 77686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catggtttccctgagctata

SEQ ID NO: 77687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacatggtttccctgagct

SEQ ID NO: 77688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attacatggtttccctgagc

SEQ ID NO: 77689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgcgtttattacatggttt

SEQ ID NO: 77690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggtgcgtttattacatgg

SEQ ID NO: 77691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attggtgcgtttattacatg

SEQ ID NO: 77692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttattggtgcgtttatta

SEQ ID NO: 77693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttattggtgcgtttatt

SEQ ID NO: 77694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatttattggtgcgtttat

SEQ ID NO: 77695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaactttcatttattggtgc

SEQ ID NO: 77696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attcaaactttcatttattg

SEQ ID NO: 77697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cataattgattcaaactttc

SEQ ID NO: 77698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actgcataattgattcaaac

SEQ ID NO: 77699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactgcataattgattcaaa

SEQ ID NO: 77700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgactgcataattgattcaa

SEQ ID NO: 77701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgactgcataattgattca

SEQ ID NO: 77702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtcatagaagccatttttg

SEQ ID NO: 77703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatgtcatagaagccattt

SEQ ID NO: 77704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctatgtcatagaagccatt

SEQ ID NO: 77705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttcctatgtcatagaagcc

SEQ ID NO: 77706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttcctatgtcatagaag

SEQ ID NO: 77707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgtttcctatgtcatagaa

SEQ ID NO: 77708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttctgtttcctatgtcata

SEQ ID NO: 77709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttctgtttcctatgtcat

SEQ ID NO: 77710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcttctgtttcctatgtca

SEQ ID NO: 77711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattttgcttctgtttccta

SEQ ID NO: 77712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcaagtctgaattttgct

SEQ ID NO: 77713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatcaagtctgaattttgc

SEQ ID NO: 77714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgaagaggtgtttaaatca

SEQ ID NO: 77715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgaagaggtgtttaaatc

SEQ ID NO: 77716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgaagaggtgtttaaat

SEQ ID NO: 77717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatgtagttttagtgaaga

SEQ ID NO: 77718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaatgtagttttagtgaa

SEQ ID NO: 77719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgaaatgtagttttagtga

SEQ ID NO: 77720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctgaaatgtagttttagt

SEQ ID NO: 77721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctgaaatgtagttttag

SEQ ID NO: 77722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttctgaaatgtagtttta

SEQ ID NO: 77723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcttctgaaatgtagtt

SEQ ID NO: 77724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttcttctgaaatgtagt

SEQ ID NO: 77725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattttcttctgaaatgtag

SEQ ID NO: 77726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttattttcttctgaaatgt

SEQ ID NO: 77727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctttattttcttctgaaa

SEQ ID NO: 77728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacattattctttattttct

SEQ ID NO: 77729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaatctgtacattattctt

SEQ ID NO: 77730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaaatctgtacattattct

SEQ ID NO: 77731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttccaaatctgtacatta

SEQ ID NO: 77732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taccacaatcctgtcttcca

SEQ ID NO: 77733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataccacaatcctgtcttcc

SEQ ID NO: 77734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataatgaatcttataccaca

SEQ ID NO: 77735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctaataatgaatcttatac

SEQ ID NO: 77736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacatgaatgcatgacaatt

SEQ ID NO: 77737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacatgaatgcatgacaat

SEQ ID NO: 77738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttaaacatgaatgcatg

SEQ ID NO: 77739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattatatttaaacatgaat

SEQ ID NO: 77740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattatatttaaacatgaa

SEQ ID NO: 77741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatattatatttaaacatga

SEQ ID NO: 77742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttatattatatttaaac

SEQ ID NO: 77743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgaattatctttatatta

SEQ ID NO: 77744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttatgtgaattatcttta

SEQ ID NO: 77745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagttatgtgaattatcttt

SEQ ID NO: 77746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataataataatagagccctt

SEQ ID NO: 77747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaattaataataataata

SEQ ID NO: 77748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaataaataaattaataa

SEQ ID NO: 77749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctcaaaaataaataaatta

SEQ ID NO: 77750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcaacaagagcgaaactgt

SEQ ID NO: 77751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcctgggcaacaagagcg

SEQ ID NO: 77752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cactccagcctgggcaacaa

SEQ ID NO: 77753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cggtgagccgagatcgtgcc

SEQ ID NO: 77754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gggaggcagaggttgcggtg

SEQ ID NO: 77755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactcgggaggcagaggttg

SEQ ID NO: 77756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaactcgggaggcagaggtt

SEQ ID NO: 77757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcaggagaatcgcttgaa

SEQ ID NO: 77758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggaggctgaggcaggagaa

SEQ ID NO: 77759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcaggaggctgaggcagga

SEQ ID NO: 77760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagctactcaggaggctgag

SEQ ID NO: 77761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taattccagctactcaggag

SEQ ID NO: 77762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccgggcatggtggtgggcg

SEQ ID NO: 77763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatacaaaaaattagccg

SEQ ID NO: 77764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaaaatacaaaaaattag

SEQ ID NO: 77765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactaaaaatacaaaaaatt

SEQ ID NO: 77766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaaataatacaaaaaaaga

SEQ ID NO: 77767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaaaaataatacaaaaaa

SEQ ID NO: 77768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctaaaaaataatacaaaaa

SEQ ID NO: 77769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctaaaaaataatacaaaa

SEQ ID NO: 77770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgctaaaaaataatacaaa

SEQ ID NO: 77771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgctaaaaaataatacaa

SEQ ID NO: 77772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgctaaaaaataataca

SEQ ID NO: 77773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgctaaaaaataatac

SEQ ID NO: 77774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgctaaaaaataata

SEQ ID NO: 77775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttgctaaaaaataat

SEQ ID NO: 77776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttgctaaaaaataa

SEQ ID NO: 77777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttgctaaaaaata

SEQ ID NO: 77778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttgctaaaaaat

SEQ ID NO: 77779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttgctaaaaaa

SEQ ID NO: 77780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttgctaaaaa

SEQ ID NO: 77781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtattttttttttttttt

SEQ ID NO: 77782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgtatttttttttttttt

SEQ ID NO: 77783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttcatgtattttttttttt

SEQ ID NO: 77784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaattgcttcatgtattttt

SEQ ID NO: 77785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaattgcttcatgtattt

SEQ ID NO: 77786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggaattgcttcatgtatt

SEQ ID NO: 77787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctggaattgcttcatgtat

SEQ ID NO: 77788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcgctttctggaattgctt

SEQ ID NO: 77789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcatcgctttctggaatt

SEQ ID NO: 77790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattcatcgctttctggaat

SEQ ID NO: 77791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttaattcatcgctttctg

SEQ ID NO: 77792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttaattcatcgctttct

SEQ ID NO: 77793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcaaatttaatttaattca

SEQ ID NO: 77794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcaaatttaatttaattc

SEQ ID NO: 77795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatcaaatttaatttaatt

SEQ ID NO: 77796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtacacagacagcctttaa

SEQ ID NO: 77797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatgtacacagacagccttt

SEQ ID NO: 77798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctatgtacacagacagcct

SEQ ID NO: 77799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caattctctatgtacacaga

SEQ ID NO: 77800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gattgcaattctctatgtac

SEQ ID NO: 77801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catatgaagttagattgcaa

SEQ ID NO: 77802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatatgaagttagattgca

SEQ ID NO: 77803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttacatatgaagttagatt

SEQ ID NO: 77804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttacatatgaagttagat

SEQ ID NO: 77805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatgcaatttgtttacata

SEQ ID NO: 77806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atagattagaatgcaatttg

SEQ ID NO: 77807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagaatatactaatagatt

SEQ ID NO: 77808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttacaagaatatactaatag

SEQ ID NO: 77809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttacaagaatatactaata

SEQ ID NO: 77810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgttacaagaatatacta

SEQ ID NO: 77811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agacagctacttgttacaag

SEQ ID NO: 77812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctgagacagctacttgtta

SEQ ID NO: 77813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgattggctgagacagctac

SEQ ID NO: 77814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgtgattggctgagacagc

SEQ ID NO: 77815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agctgctgtgattggctgag

SEQ ID NO: 77816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagctcagctgctgtgattg

SEQ ID NO: 77817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctgaagctcagctgctgtg

SEQ ID NO: 77818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggttggctgaagctcagct

SEQ ID NO: 77819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataaatcagcaggctgtggt

SEQ ID NO: 77820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgataaatcagcaggctg

SEQ ID NO: 77821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtggacattgtctgataaa

SEQ ID NO: 77822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgtggacattgtctgataa

SEQ ID NO: 77823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccttatgtggacattgtctg

SEQ ID NO: 77824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccttatgtggacattgtct

SEQ ID NO: 77825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatttgccttatgtggaca

SEQ ID NO: 77826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacatttgccttatgtggac

SEQ ID NO: 77827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagcttgacatttgccttat

SEQ ID NO: 77828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagcttgacatttgcctta

SEQ ID NO: 77829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttatagcttgacatttgcc

SEQ ID NO: 77830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attgcttatagcttgacatt

SEQ ID NO: 77831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gattgcttatagcttgacat

SEQ ID NO: 77832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagacagaaaaagggagtga

SEQ ID NO: 77833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagacagaaaaagggagtg

SEQ ID NO: 77834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcaacatgagcaggagtat

SEQ ID NO: 77835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aactcagcaacatgagcagg

SEQ ID NO: 77836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggagagctcaactcagcaac

SEQ ID NO: 77837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaaccaagagaagttcgga

SEQ ID NO: 77838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcagcactcagaaccaaga

SEQ ID NO: 77839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggcagcactcagaaccaag

SEQ ID NO: 77840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaataagataataataataa

SEQ ID NO: 77841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgaaataagataataataa

SEQ ID NO: 77842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgctgaaataagataataa

SEQ ID NO: 77843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgctgaaataagataata

SEQ ID NO: 77844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcaatgaaatagtatttat

SEQ ID NO: 77845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcaatgaaatagtattta

SEQ ID NO: 77846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcagcaatgaaatagtat

SEQ ID NO: 77847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttcagcaatgaaatagta

SEQ ID NO: 77848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcagcttatttcagcaatga

SEQ ID NO: 77849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcagcttatttcagcaatg

SEQ ID NO: 77850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttagcagcttatttcag

SEQ ID NO: 77851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacaaattaaatttagcagc

SEQ ID NO: 77852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacaaattaaatttagcag

SEQ ID NO: 77853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaacaaattaaatttagca

SEQ ID NO: 77854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagaaaaattttcaacaaa

SEQ ID NO: 77855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaaagaaaaattttcaac

SEQ ID NO: 77856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaaaagaaaaattttcaa

SEQ ID NO: 77857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttaaaagaaaaattttca

SEQ ID NO: 77858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acctttgttaaaagaaaaat

SEQ ID NO: 77859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacctttgttaaaagaaaaa

SEQ ID NO: 77860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaacctttgttaaaagaaa

SEQ ID NO: 77861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaacctttgttaaaagaa

SEQ ID NO: 77862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttaacctttgttaaaaga

SEQ ID NO: 77863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaatggttttcttaacctt

SEQ ID NO: 77864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactgtgaatggttttctta

SEQ ID NO: 77865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atactgtgaatggttttctt

SEQ ID NO: 77866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtttatactgtgaatggtt

SEQ ID NO: 77867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagtttatactgtgaatgg

SEQ ID NO: 77868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgagtttatactgtgaatg

SEQ ID NO: 77869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctgagtttatactgtga

SEQ ID NO: 77870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctatttctgagtttatactg

SEQ ID NO: 77871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcctatttctgagtttata

SEQ ID NO: 77872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctcctatttctgagtttat

SEQ ID NO: 77873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtcttgctcctatttctga

SEQ ID NO: 77874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagtcttgctcctatttct

SEQ ID NO: 77875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctgagtcttgctcctatt

SEQ ID NO: 77876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctgagtcttgctcctat

SEQ ID NO: 77877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattctgagtcttgctccta

SEQ ID NO: 77878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattctgagtcttgctcct

SEQ ID NO: 77879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tccttttattctgagtcttg

SEQ ID NO: 77880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggatctgtccttttattctg

SEQ ID NO: 77881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgggatctgtccttttat

SEQ ID NO: 77882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcactgggatctgtcctttt

SEQ ID NO: 77883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcactgggatctgtccttt

SEQ ID NO: 77884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcactgggatctgtcctt

SEQ ID NO: 77885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttttctcactgggatctg

SEQ ID NO: 77886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagttttctcactgggatct

SEQ ID NO: 77887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacttaagttttctcactgg

SEQ ID NO: 77888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacttaagttttctcactg

SEQ ID NO: 77889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaaacttaagttttctca

SEQ ID NO: 77890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttaaacttaagttttctc

SEQ ID NO: 77891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccacacttatttaaacttaa

SEQ ID NO: 77892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accacacttatttaaactta

SEQ ID NO: 77893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taccacacttatttaaactt

SEQ ID NO: 77894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaccacacttatttaaa

SEQ ID NO: 77895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagattattttaccacactt

SEQ ID NO: 77896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atattgtagattattttacc

SEQ ID NO: 77897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatattgtagattattttac

SEQ ID NO: 77898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttaatattgtagattat

SEQ ID NO: 77899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatttaatattgtagatta

SEQ ID NO: 77900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgagtaacttacatttaat

SEQ ID NO: 77901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatatctgatgagtaactt

SEQ ID NO: 77902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaaattaatatatctgatg

SEQ ID NO: 77903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgctgtaaaattaatata

SEQ ID NO: 77904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgctgtaaaattaatat

SEQ ID NO: 77905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttatatgctgtaaaatta

SEQ ID NO: 77906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatttatatgctgtaaaatt

SEQ ID NO: 77907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaatttatatgctgtaaaa

SEQ ID NO: 77908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaatttatatgctgtaaa

SEQ ID NO: 77909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcttaatttatatgctgt

SEQ ID NO: 77910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcttaatttatatgctg

SEQ ID NO: 77911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttcttaatttatatgct

SEQ ID NO: 77912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caatggatggagaattttat

SEQ ID NO: 77913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaatggatggagaatttta

SEQ ID NO: 77914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttccaatggatggagaatt

SEQ ID NO: 77915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttccaatggatggagaat

SEQ ID NO: 77916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaacttatttccaatggatg

SEQ ID NO: 77917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaacttatttccaatggat

SEQ ID NO: 77918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaacatgatttgaaactta

SEQ ID NO: 77919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttacaaacatgatttgaaac

SEQ ID NO: 77920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attgttacaaacatgatttg

SEQ ID NO: 77921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgattgttacaaacatgatt

SEQ ID NO: 77922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgattgttacaaacatgat

SEQ ID NO: 77923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagtttctgattgttacaaa

SEQ ID NO: 77924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagtttctgattgttacaa

SEQ ID NO: 77925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccagtttctgattgttaca

SEQ ID NO: 77926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccagtttctgattgttac

SEQ ID NO: 77927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttccagtttctgattgtt

SEQ ID NO: 77928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctcttttccagtttctga

SEQ ID NO: 77929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accctcttttccagtttctg

SEQ ID NO: 77930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttaccctcttttccagt

SEQ ID NO: 77931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttaccctcttttccag

SEQ ID NO: 77932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatttaccctcttttcca

SEQ ID NO: 77933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatatttaccctcttttcc

SEQ ID NO: 77934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttatatttaccctcttttc

SEQ ID NO: 77935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttatatttaccctcttt

SEQ ID NO: 77936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttttatatttaccctctt

SEQ ID NO: 77937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccttctttttatatttacc

SEQ ID NO: 77938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccttctttttatatttac

SEQ ID NO: 77939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccccttctttttatattta

SEQ ID NO: 77940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatattttccccttctttt

SEQ ID NO: 77941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcatattttccccttcttt

SEQ ID NO: 77942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgaggaatttagcatattt

SEQ ID NO: 77943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgaggaatttagcatatt

SEQ ID NO: 77944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaccatttgatgaggaatt

SEQ ID NO: 77945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaccaccatttgatgagga

SEQ ID NO: 77946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actaccaccatttgatgagg

SEQ ID NO: 77947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactaccaccatttgatgag

SEQ ID NO: 77948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactaccaccatttgatga

SEQ ID NO: 77949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatatatatttttactacc

SEQ ID NO: 77950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcatatatatttttactac

SEQ ID NO: 77951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtaaaatgtttagcatat

SEQ ID NO: 77952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagtaaaatgtttagcata

SEQ ID NO: 77953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagtaaaatgtttagcat

SEQ ID NO: 77954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagttttgaagtaaaatgt

SEQ ID NO: 77955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaagaaaactgaaagtttt

SEQ ID NO: 77956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacaagaaaactgaaagttt

SEQ ID NO: 77957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaataaaatgacagaaaaa

SEQ ID NO: 77958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcccacatggtaaaagacta

SEQ ID NO: 77959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgataaataaaatcaaataa

SEQ ID NO: 77960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgtgataaataaaatcaa

SEQ ID NO: 77961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actcactgtgataaataaaa

SEQ ID NO: 77962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcactcactgtgataaataa

SEQ ID NO: 77963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcactcactgtgataaata

SEQ ID NO: 77964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcactcactgtgataaat

SEQ ID NO: 77965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaaatgtgtcctttctcac

SEQ ID NO: 77966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accaaatgtgtcctttctca

SEQ ID NO: 77967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taccaaatgtgtcctttctc

SEQ ID NO: 77968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaccaaatgtgtccttt

SEQ ID NO: 77969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttaccaaatgtgtcctt

SEQ ID NO: 77970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattttaccaaatgtgtcc

SEQ ID NO: 77971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttattttaccaaatgtgtc

SEQ ID NO: 77972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttattttaccaaatgtgt

SEQ ID NO: 77973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataataaaaagtaatatac

SEQ ID NO: 77974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agataataaaaagtaatata

SEQ ID NO: 77975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttagataataaaaagtaat

SEQ ID NO: 77976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccttagataataaaaagta

SEQ ID NO: 77977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaaaaggaaatgagggagg

SEQ ID NO: 77978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgccaaaaggaaatgaggg

SEQ ID NO: 77979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatatatgtgctgttgcca

SEQ ID NO: 77980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatatatgtgctgttgcc

SEQ ID NO: 77981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaatatatgtgctgttgc

SEQ ID NO: 77982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acccaggtgtggtatggaag

SEQ ID NO: 77983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacccaggtgtggtatggaa

SEQ ID NO: 77984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagataatttgacccaggt

SEQ ID NO: 77985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatagataatttgacccagg

SEQ ID NO: 77986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggtgcccacgtgaataca

SEQ ID NO: 77987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctgatggtgcccacgtgaa

SEQ ID NO: 77988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatgtatctatctgatggt

SEQ ID NO: 77989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acacctggaatgtatctatc

SEQ ID NO: 77990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctgacacctggaatgtatc

SEQ ID NO: 77991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtctgacacctggaatgta

SEQ ID NO: 77992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtctgacacctggaatgt

SEQ ID NO: 77993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgtctgacacctggaatg

SEQ ID NO: 77994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactttctgtctgacacctg

SEQ ID NO: 77995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgaagatatgatcaagat

SEQ ID NO: 77996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgaatattggatgaagata

SEQ ID NO: 77997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaacggttgatgaatattgg

SEQ ID NO: 77998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actggaacggttgatgaata

SEQ ID NO: 77999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcactggaacggttgatgaa

SEQ ID NO: 78000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcatggtgtctctcactgga

SEQ ID NO: 78001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcccctagcatggtgtctct

SEQ ID NO: 78002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacaattatcccctagcatg

SEQ ID NO: 78003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaacaattatcccctagca

SEQ ID NO: 78004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaaacaattatcccctag

SEQ ID NO: 78005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgttctctaaacaattat

SEQ ID NO: 78006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataaagcatgaattgaatg

SEQ ID NO: 78007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acataaagcatgaattgaat

SEQ ID NO: 78008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacataaagcatgaattga

SEQ ID NO: 78009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttacataaagcatgaattg

SEQ ID NO: 78010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagtttcttacataaagcat

SEQ ID NO: 78011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaagtatcaattagagttt

SEQ ID NO: 78012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcagaagtatcaattaga

SEQ ID NO: 78013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattcagaagtatcaattag

SEQ ID NO: 78014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttaattcagaagtatcaat

SEQ ID NO: 78015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaagtctgcttaattcaga

SEQ ID NO: 78016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcagaagtctgcttaattca

SEQ ID NO: 78017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatgcactctcagaagtctg

SEQ ID NO: 78018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taggtaccacatgagatcat

SEQ ID NO: 78019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtaggtaccacatgagatc

SEQ ID NO: 78020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtaggtaccacatgagat

SEQ ID NO: 78021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctgtaggtaccacatga

SEQ ID NO: 78022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtagaattatttctgtagg

SEQ ID NO: 78023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttcagtagaattatttctg

SEQ ID NO: 78024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttcagtagaattatttct

SEQ ID NO: 78025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggcaagatatcaaagttt

SEQ ID NO: 78026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatataggctgatggcaaga

SEQ ID NO: 78027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caatataggctgatggcaag

SEQ ID NO: 78028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcaatataggctgatggc

SEQ ID NO: 78029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttcaatataggctgatgg

SEQ ID NO: 78030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggcttccttcaatatagg

SEQ ID NO: 78031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatggcttccttcaatatag

SEQ ID NO: 78032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatggcttccttcaatata

SEQ ID NO: 78033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatggcttccttcaatat

SEQ ID NO: 78034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttaatggcttccttcaa

SEQ ID NO: 78035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagctgtttttaatggctt

SEQ ID NO: 78036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catagctgtttttaatggct

SEQ ID NO: 78037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaccaatgacgagtttcat

SEQ ID NO: 78038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaccaatgacgagtttca

SEQ ID NO: 78039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtaaccaatgacgagtttc

SEQ ID NO: 78040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaacatccactttgtaacc

SEQ ID NO: 78041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcaacatccactttgtaac

SEQ ID NO: 78042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatcaacatccactttgtaa

SEQ ID NO: 78043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agctttatcaacatccactt

SEQ ID NO: 78044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcagctttatcaacatcca

SEQ ID NO: 78045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctcagctttatcaacatcc

SEQ ID NO: 78046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacaaagcaaaatcatttgc

SEQ ID NO: 78047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacaaagcaaaatcatttg

SEQ ID NO: 78048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagatttgtacaaagcaaaa

SEQ ID NO: 78049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaaagatttgtacaaagca

SEQ ID NO: 78050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagtattcctaaagatttg

SEQ ID NO: 78051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatagtattcctaaagattt

SEQ ID NO: 78052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatcttgatagtattcctaa

SEQ ID NO: 78053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaatataaagatagtatc

SEQ ID NO: 78054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attatcaaatataaagatag

SEQ ID NO: 78055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcatatataatgataatat

SEQ ID NO: 78056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaatcatatataatgataa

SEQ ID NO: 78057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattaatcatatataatgat

SEQ ID NO: 78058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagttctattaatcatatat

SEQ ID NO: 78059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagttctattaatcatata

SEQ ID NO: 78060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taacatcttaaagttctatt

SEQ ID NO: 78061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataactataacatcttaaag

SEQ ID NO: 78062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactcataactataacatct

SEQ ID NO: 78063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagattgtactcataacta

SEQ ID NO: 78064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatagattgtactcataact

SEQ ID NO: 78065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacttaatagattgtactca

SEQ ID NO: 78066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacttaatagattgtactc

SEQ ID NO: 78067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatacttaatagattgtact

SEQ ID NO: 78068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatacttaatagattgtac

SEQ ID NO: 78069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatagatttttatacttaa

SEQ ID NO: 78070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatgatagatttttatact

SEQ ID NO: 78071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatgatagatttttatac

SEQ ID NO: 78072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatataatgtgacatattta

SEQ ID NO: 78073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatatataatgtgacatat

SEQ ID NO: 78074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatatataatgtgacata

SEQ ID NO: 78075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttattatatataatgtg

SEQ ID NO: 78076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatttattatatataatgt

SEQ ID NO: 78077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatagtacatacttatattt

SEQ ID NO: 78078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatatagtacatacttata

SEQ ID NO: 78079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatatagtacatacttat

SEQ ID NO: 78080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattatatagtacatactta

SEQ ID NO: 78081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataattttattatatagta

SEQ ID NO: 78082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atataattttattatatagt

SEQ ID NO: 78083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatataattttattatatag

SEQ ID NO: 78084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatattttatataattttat

SEQ ID NO: 78085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaatataatagattatata

SEQ ID NO: 78086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaatataatagattatat

SEQ ID NO: 78087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttaacaatataatagat

SEQ ID NO: 78088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accattacatttaacaatat

SEQ ID NO: 78089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataacattaaccattacatt

SEQ ID NO: 78090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattaataacattaaccatt

SEQ ID NO: 78091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaattaataacattaaccat

SEQ ID NO: 78092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagaaataaatgtagccttg

SEQ ID NO: 78093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagagaaataaatgtagcct

SEQ ID NO: 78094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctagagaaataaatgtagc

SEQ ID NO: 78095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctagagaaataaatgtag

SEQ ID NO: 78096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctagagaaataaatgta

SEQ ID NO: 78097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttctctagagaaataaat

SEQ ID NO: 78098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatcataaaaaagaattatt

SEQ ID NO: 78099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatatcataaaaaagaatta

SEQ ID NO: 78100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatatcataaaaaagaatt

SEQ ID NO: 78101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttctatatcataaaaaag

SEQ ID NO: 78102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaatttctatatcataaaa

SEQ ID NO: 78103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cataattcctaatttctata

SEQ ID NO: 78104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaaaaggaacacaggatag

SEQ ID NO: 78105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcagtactggcaaaaggaac

SEQ ID NO: 78106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctagcagtactggcaaaag

SEQ ID NO: 78107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agctatctagcagtactggc

SEQ ID NO: 78108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagctatctagcagtactg

SEQ ID NO: 78109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttctaagctatctagcagt

SEQ ID NO: 78110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaatcatcctggttctaa

SEQ ID NO: 78111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cataaatcatcctggttcta

SEQ ID NO: 78112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcataaatcatcctggttct

SEQ ID NO: 78113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatgattttcataaatca

SEQ ID NO: 78114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtcatgttatatatgattt

SEQ ID NO: 78115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtcatgttatatatgatt

SEQ ID NO: 78116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagtgtgaatttgggtcatg

SEQ ID NO: 78117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctacagtgtgaatttgggtc

SEQ ID NO: 78118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatatatagaaagctgcta

SEQ ID NO: 78119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcaaatatatagaaagctg

SEQ ID NO: 78120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagctattcaaatatatag

SEQ ID NO: 78121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaagctattcaaatatata

SEQ ID NO: 78122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcatttcaaagctattcaa

SEQ ID NO: 78123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcatttcaaagctattca

SEQ ID NO: 78124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatcatttcaaagctattc

SEQ ID NO: 78125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttaatcatttcaaagct

SEQ ID NO: 78126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattttaatcatttcaaagc

SEQ ID NO: 78127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcattttaatcatttcaaag

SEQ ID NO: 78128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttcattttaatcatttca

SEQ ID NO: 78129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatgaaatgttgctttca

SEQ ID NO: 78130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataatgaaatgttgctttc

SEQ ID NO: 78131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taataatgaaatgttgcttt

SEQ ID NO: 78132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaataatgaaatgttgctt

SEQ ID NO: 78133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttaataatgaaatgttgc

SEQ ID NO: 78134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttttaataatgaaatgtt

SEQ ID NO: 78135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctcttttaataatgaaat

SEQ ID NO: 78136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaacattgctctcttttaa

SEQ ID NO: 78137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaataatgctaaaaacattg

SEQ ID NO: 78138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggttgaaataatgctaaaaa

SEQ ID NO: 78139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaggttgaaataatgctaa

SEQ ID NO: 78140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttattaggttgaaataatgc

SEQ ID NO: 78141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttattaggttgaaataatg

SEQ ID NO: 78142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catttgttattaggttgaaa

SEQ ID NO: 78143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcatttgttattaggttgaa

SEQ ID NO: 78144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagtaagaatgtccttgca

SEQ ID NO: 78145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaagtaagaatgtccttgc

SEQ ID NO: 78146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagaagtaagaatgtccttg

SEQ ID NO: 78147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagagtgaagaagactttag

SEQ ID NO: 78148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaagcataatgaataccct

SEQ ID NO: 78149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaataatgaaacattagaa

SEQ ID NO: 78150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaaataatgaaacattaga

SEQ ID NO: 78151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttgaaaataatgaaacat

SEQ ID NO: 78152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gaaattcacttgaaaataat

SEQ ID NO: 78153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgaaattcacttgaaaataa

SEQ ID NO: 78154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgaaattcacttgaaaata

SEQ ID NO: 78155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagcataaatgttttcgaaa

SEQ ID NO: 78156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgggaaacctgaagcataa

SEQ ID NO: 78157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcatgggaaacctgaagca

SEQ ID NO: 78158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagctgttcatgggaaacct

SEQ ID NO: 78159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gactacagctgttcatggga

SEQ ID NO: 78160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attggactacagctgttcat

SEQ ID NO: 78161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cactaattggactacagctg

SEQ ID NO: 78162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcactaattggactacagct

SEQ ID NO: 78163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtgtgtttgcactaattgg

SEQ ID NO: 78164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctgagtgtgtttgcactaa

SEQ ID NO: 78165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtctgagtgtgtttgcact

SEQ ID NO: 78166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttctgtctgagtgtgttt

SEQ ID NO: 78167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actgtgttctgtctgagtgt

SEQ ID NO: 78168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgtcatgatcctgactgtg

SEQ ID NO: 78169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatgtcatgatcctgactg

SEQ ID NO: 78170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgatgtcatgatcctgact

SEQ ID NO: 78171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgatgtcatgatcctgac

SEQ ID NO: 78172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atccagtcagtgaagaagct

SEQ ID NO: 78173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatccagtcagtgaagaagc

SEQ ID NO: 78174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatccagtcagtgaagaag

SEQ ID NO: 78175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taggggctttgatccagtca

SEQ ID NO: 78176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagacaattgtaggggcttt

SEQ ID NO: 78177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggcctgaagacaattgtag

SEQ ID NO: 78178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggcctgaagacaattgta

SEQ ID NO: 78179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaggcctgaagacaattgt

SEQ ID NO: 78180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccattttcaggcctgaagac

SEQ ID NO: 78181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccattttcaggcctgaag

SEQ ID NO: 78182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcccattttcaggcctgaa

SEQ ID NO: 78183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcccattttcaggcctga

SEQ ID NO: 78184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcccattttcaggcctg

SEQ ID NO: 78185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctcccattttcaggcct

SEQ ID NO: 78186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttctcccattttcaggcc

SEQ ID NO: 78187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaacacttttttctcccat

SEQ ID NO: 78188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtcattacaaacacttttt

SEQ ID NO: 78189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtcattacaaacactttt

SEQ ID NO: 78190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgtcattacaaacacttt

SEQ ID NO: 78191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaggctttatgtcattaca

SEQ ID NO: 78192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gattcagaggctttatgtca

SEQ ID NO: 78193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgattcagaggctttatgtc

SEQ ID NO: 78194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcgattcagaggctttat

SEQ ID NO: 78195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttcgattcagaggcttta

SEQ ID NO: 78196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttcgattcagaggcttt

SEQ ID NO: 78197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtttcgattcagaggctt

SEQ ID NO: 78198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtttcgattcagaggct

SEQ ID NO: 78199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttttttgtttcgattcag

SEQ ID NO: 78200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgttttttgtttcgattca

SEQ ID NO: 78201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggaaagcttgtgttttttgt

SEQ ID NO: 78202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggaaagcttgtgtttttt

SEQ ID NO: 78203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaggaaagcttgtgttttt

SEQ ID NO: 78204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctaggaaagcttgtgtttt

SEQ ID NO: 78205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atataatgcatgactttcta

SEQ ID NO: 78206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatataatgcatgactttct

SEQ ID NO: 78207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttgatataatgcatgact

SEQ ID NO: 78208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggtcattgatttgatataa

SEQ ID NO: 78209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaggtcattgatttgatata

SEQ ID NO: 78210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttaaggtcattgatttgat

SEQ ID NO: 78211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggttacttaaggtcattgat

SEQ ID NO: 78212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattaggttacttaaggtca

SEQ ID NO: 78213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattaggttacttaaggtc

SEQ ID NO: 78214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaattaggttacttaaggt

SEQ ID NO: 78215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaattaggttacttaagg

SEQ ID NO: 78216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgaattaggttacttaag

SEQ ID NO: 78217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgaattaggttacttaa

SEQ ID NO: 78218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttgaattaggttactta

SEQ ID NO: 78219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatatataaaaacaaagta

SEQ ID NO: 78220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtaatatataaaaacaaa

SEQ ID NO: 78221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgtaatatataaaaacaa

SEQ ID NO: 78222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accatttgctgtaatatata

SEQ ID NO: 78223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaccatttgctgtaatatat

SEQ ID NO: 78224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaccatttgctgtaatata

SEQ ID NO: 78225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaccatttgctgtaatat

SEQ ID NO: 78226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttttaaccatttgctgtaa

SEQ ID NO: 78227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatttttaaccatttgctg

SEQ ID NO: 78228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaatatgttcctattttta

SEQ ID NO: 78229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaatatgttcctattttt

SEQ ID NO: 78230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagaatatgttcctatttt

SEQ ID NO: 78231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgagaatatgttcctatt

SEQ ID NO: 78232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtattctttgagaatatgt

SEQ ID NO: 78233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaacctaggtattctttga

SEQ ID NO: 78234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacaacctaggtattctttg

SEQ ID NO: 78235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacaacctaggtattcttt

SEQ ID NO: 78236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttgacaacctaggtatt

SEQ ID NO: 78237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcattttgacaacctaggt

SEQ ID NO: 78238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatagccaaattgttcattt

SEQ ID NO: 78239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatagccaaattgttcatt

SEQ ID NO: 78240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtggtttgaatagccaaa

SEQ ID NO: 78241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtggtttgaatagccaa

SEQ ID NO: 78242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagtggtttgaatagcca

SEQ ID NO: 78243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaagtggtttgaatagcc

SEQ ID NO: 78244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttaaagtggtttgaata

SEQ ID NO: 78245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaaattatttttaaagtg

SEQ ID NO: 78246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaaaaattatttttaaagt

SEQ ID NO: 78247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaacttacaaaaattatttt

SEQ ID NO: 78248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaaacattagaacttacaa

SEQ ID NO: 78249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacaaacattagaacttaca

SEQ ID NO: 78250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgacaaacattagaactt

SEQ ID NO: 78251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgacaaacattagaact

SEQ ID NO: 78252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagagaagtggtttgtttga

SEQ ID NO: 78253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagagaagtggtttgtttg

SEQ ID NO: 78254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgccatttatagagaagtg

SEQ ID NO: 78255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgccatttatagagaagt

SEQ ID NO: 78256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtgccatttatagagaag

SEQ ID NO: 78257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttggtgccatttatagag

SEQ ID NO: 78258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttggtgccatttataga

SEQ ID NO: 78259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatttgttttggtgccatt

SEQ ID NO: 78260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgctgtaatttgttttgg

SEQ ID NO: 78261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaggtgtcactatatgctg

SEQ ID NO: 78262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacaaggtgtcactatatg

SEQ ID NO: 78263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaattattacaaggtgtca

SEQ ID NO: 78264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaaaattattacaaggtg

SEQ ID NO: 78265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgaaaattattacaaggt

SEQ ID NO: 78266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattgaaaattattacaagg

SEQ ID NO: 78267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttattgaaaattattacaa

SEQ ID NO: 78268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttattgaaaattattaca

SEQ ID NO: 78269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcaaaccatttctttattg

SEQ ID NO: 78270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagcaaaccatttctttat

SEQ ID NO: 78271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcagcaaaccatttcttta

SEQ ID NO: 78272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcagcaaaccatttcttt

SEQ ID NO: 78273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcagcaaaccatttctt

SEQ ID NO: 78274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctcagcaaaccatttct

SEQ ID NO: 78275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttctcagcaaaccatt

SEQ ID NO: 78276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttctcagcaaaccat

SEQ ID NO: 78277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttctcagcaaacca

SEQ ID NO: 78278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttttctcagcaaacc

SEQ ID NO: 78279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattttttctcagcaaac

SEQ ID NO: 78280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttttattttttctcagca

SEQ ID NO: 78281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgacattgttttttattt

SEQ ID NO: 78282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaaagagatcataaatatc

SEQ ID NO: 78283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggaaagagatcataaatat

SEQ ID NO: 78284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatacttaggaaagagatc

SEQ ID NO: 78285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatacttaggaaagagat

SEQ ID NO: 78286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatacttaggaaagaga

SEQ ID NO: 78287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttaaaatacttaggaaa

SEQ ID NO: 78288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgattttaaaatacttag

SEQ ID NO: 78289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattgattttaaaatactta

SEQ ID NO: 78290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattgattttaaaatactt

SEQ ID NO: 78291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatccattttaattgatttt

SEQ ID NO: 78292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatccattttaattgattt

SEQ ID NO: 78293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacaggaaggaaaatttcaa

SEQ ID NO: 78294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atacaggaaggaaaatttca

SEQ ID NO: 78295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttatacaggaaggaaaatt

SEQ ID NO: 78296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttatacaggaaggaaaat

SEQ ID NO: 78297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttgcttatacaggaagg

SEQ ID NO: 78298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatttgcttatacaggaag

SEQ ID NO: 78299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatttgcttatacaggaa

SEQ ID NO: 78300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccatttgcttatacagga

SEQ ID NO: 78301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttccatttgcttataca

SEQ ID NO: 78302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttccatttgcttatac

SEQ ID NO: 78303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agggtttgtttttccatttg

SEQ ID NO: 78304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctgagggtttgtttttcca

SEQ ID NO: 78305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgtctgagggtttgttttt

SEQ ID NO: 78306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctcctgtctgagggtttgt

SEQ ID NO: 78307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctcctgtctgagggtttg

SEQ ID NO: 78308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatcttccctcctgtctga

SEQ ID NO: 78309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaatcttccctcctgtctg

SEQ ID NO: 78310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacttgaaatcttccctcct

SEQ ID NO: 78311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acatctcaacttgaaatctt

SEQ ID NO: 78312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcacatctcaacttgaaa

SEQ ID NO: 78313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggctcacatctcaacttgaa

SEQ ID NO: 78314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttggctcacatctcaactt

SEQ ID NO: 78315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggatgaggatgactacttgg

SEQ ID NO: 78316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggatgaggatgactacttg

SEQ ID NO: 78317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taggatgaggatgactactt

SEQ ID NO: 78318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgggtctttaggatgagg

SEQ ID NO: 78319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcaattgcatgggtcttta

SEQ ID NO: 78320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcaattgcatgggtcttt

SEQ ID NO: 78321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtttaatcaattgcatggg

SEQ ID NO: 78322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtttaatcaattgcatgg

SEQ ID NO: 78323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagtttaatcaattgcatg

SEQ ID NO: 78324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaaagtcaacctttgagt

SEQ ID NO: 78325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacaatcattatcaaaagtc

SEQ ID NO: 78326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacaatcattatcaaaagt

SEQ ID NO: 78327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccacaatcattatcaaaag

SEQ ID NO: 78328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttccacaatcattatcaa

SEQ ID NO: 78329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttttccacaatcattatc

SEQ ID NO: 78330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgttttccacaatcattat

SEQ ID NO: 78331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctgttttccacaatcatt

SEQ ID NO: 78332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctgttttccacaatcat

SEQ ID NO: 78333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttcttctgttttccacaa

SEQ ID NO: 78334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttcttctgttttccaca

SEQ ID NO: 78335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttgatttcttctgtttt

SEQ ID NO: 78336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaaatttgatttcttctg

SEQ ID NO: 78337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattaaatttgatttcttct

SEQ ID NO: 78338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattaaatttgatttcttc

SEQ ID NO: 78339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcaattttaattaaatttg

SEQ ID NO: 78340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgcaattttaattaaattt

SEQ ID NO: 78341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgcaattttaattaaatt

SEQ ID NO: 78342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttatgcaattttaattaaa

SEQ ID NO: 78343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttatgcaattttaattaa

SEQ ID NO: 78344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctttatgcaattttaatta

SEQ ID NO: 78345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagaaagacataaaaaaaa

SEQ ID NO: 78346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagaaagacataaaaaaa

SEQ ID NO: 78347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaagaaagacataaaaaa

SEQ ID NO: 78348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaaagaaagacataaaaa

SEQ ID NO: 78349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcttttgaaagaaagacat

SEQ ID NO: 78350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcttttgaaagaaagaca

SEQ ID NO: 78351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatcttttgaaagaaagac

SEQ ID NO: 78352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actttgatcttttgaaagaa

SEQ ID NO: 78353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacaccagggctgactttga

SEQ ID NO: 78354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caggtgagagtggggttaaa

SEQ ID NO: 78355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtcattccaggtgagagtg

SEQ ID NO: 78356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtcattccaggtgagagt

SEQ ID NO: 78357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaacaatttcagtcattcc

SEQ ID NO: 78358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgagcattgaaaacaatttc

SEQ ID NO: 78359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccgagcattgaaaacaatt

SEQ ID NO: 78360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagttctccgagcattgaa

SEQ ID NO: 78361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaacattcagagttctccg

SEQ ID NO: 78362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcattgagaacattcagag

SEQ ID NO: 78363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcaatgtctcagcattgag

SEQ ID NO: 78364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggacctgggcaatgtctca

SEQ ID NO: 78365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggacctgggcaatgtctc

SEQ ID NO: 78366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagatatgtgacagagtttg

SEQ ID NO: 78367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttacagatatgtgacagagt

SEQ ID NO: 78368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccctattacagatatgtgac

SEQ ID NO: 78369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgtataaactcccctatt

SEQ ID NO: 78370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgtgtgtcgtcactgtgt

SEQ ID NO: 78371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtgtgtgtcgtcactgtg

SEQ ID NO: 78372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtttgtgtgtgtgtcgtcac

SEQ ID NO: 78373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcgtttgtgtgtgtgtcgt

SEQ ID NO: 78374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttcgtttgtgtgtgtgtcg

SEQ ID NO: 78375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttcgtttgtgtgtgtgtc

SEQ ID NO: 78376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgttcgtttgtgtgtgtg

SEQ ID NO: 78377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctttgttcgtttgtgtgt

SEQ ID NO: 78378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggagttgttctttgttcgtt

SEQ ID NO: 78379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggagttgttctttgttcgt

SEQ ID NO: 78380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgggagttgttctttgtt

SEQ ID NO: 78381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caactatttgggagttgttc

SEQ ID NO: 78382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataactccaactatttggga

SEQ ID NO: 78383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggccactcataactccaact

SEQ ID NO: 78384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtgaagcattaggccact

SEQ ID NO: 78385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatcccaggtaagaagtaa

SEQ ID NO: 78386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtaatcccaggtaagaagt

SEQ ID NO: 78387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtaatcccaggtaagaag

SEQ ID NO: 78388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctgtaatcccaggtaag

SEQ ID NO: 78389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaactatttctgtaatccc

SEQ ID NO: 78390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaactatttctgtaatcc

SEQ ID NO: 78391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaaaactatttctgtaatc

SEQ ID NO: 78392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagctttgaaaactatttc

SEQ ID NO: 78393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagtattgagagctttgaa

SEQ ID NO: 78394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagagtattgagagctttga

SEQ ID NO: 78395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagagtattgagagctttg

SEQ ID NO: 78396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gaactttcagagtattgaga

SEQ ID NO: 78397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgaactttcagagtattgag

SEQ ID NO: 78398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcgaactttcagagtattg

SEQ ID NO: 78399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctcttcgaactttcagag

SEQ ID NO: 78400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagctcttcgaactttcaga

SEQ ID NO: 78401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcaatgtttcagctcttcg

SEQ ID NO: 78402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaacctaggcaatgtttca

SEQ ID NO: 78403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaacctaggcaatgtttc

SEQ ID NO: 78404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagaatttgtaaacctagg

SEQ ID NO: 78405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacagaatttgtaaacctag

SEQ ID NO: 78406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caggtatttaacagaatttg

SEQ ID NO: 78407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaggtatttaacagaatt

SEQ ID NO: 78408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attctacaggtatttaacag

SEQ ID NO: 78409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattctacaggtatttaaca

SEQ ID NO: 78410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttaattctacaggtattt

SEQ ID NO: 78411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatttaattctacaggtat

SEQ ID NO: 78412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aataattctgatttaattct

SEQ ID NO: 78413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaataattctgatttaatt

SEQ ID NO: 78414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattctgaataattctgatt

SEQ ID NO: 78415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctaaattctgaataattct

SEQ ID NO: 78416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatctaaattctgaataatt

SEQ ID NO: 78417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggtaagtatcatagactct

SEQ ID NO: 78418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaggctcaggtaagtatcat

SEQ ID NO: 78419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actaaaggctcaggtaagta

SEQ ID NO: 78420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gactaaaggctcaggtaagt

SEQ ID NO: 78421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatagaagccccaaacgta

SEQ ID NO: 78422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatagaagccccaaacgt

SEQ ID NO: 78423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacatttaaaatagaagccc

SEQ ID NO: 78424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagaactatacatttaaaat

SEQ ID NO: 78425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcagaactatacatttaaaa

SEQ ID NO: 78426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatagcaaaaaagacttgc

SEQ ID NO: 78427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttatgatagcaaaaaagac

SEQ ID NO: 78428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttagttatgatagcaaaa

SEQ ID NO: 78429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaagttagttatgatag

SEQ ID NO: 78430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attaaattaagttagttatg

SEQ ID NO: 78431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catcaaatgagtcaaatcaa

SEQ ID NO: 78432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatcaaatgagtcaaatca

SEQ ID NO: 78433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgcatcaaatgagtcaaa

SEQ ID NO: 78434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgcatcaaatgagtcaa

SEQ ID NO: 78435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttgcatcaaatgagtca

SEQ ID NO: 78436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattttgtttgcatcaaatg

SEQ ID NO: 78437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatatataatatctgtat

SEQ ID NO: 78438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataatatataatatctgta

SEQ ID NO: 78439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgtatgaatccaatttaa

SEQ ID NO: 78440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtgtatgaatccaattta

SEQ ID NO: 78441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgcatttaagtgtatgaatc

SEQ ID NO: 78442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgcatttaagtgtatgaat

SEQ ID NO: 78443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttacgcatttaagtgtatg

SEQ ID NO: 78444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttgtttacgcatttaagtg

SEQ ID NO: 78445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttgtttacgcatttaagt

SEQ ID NO: 78446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaacatttagttgtttacgc

SEQ ID NO: 78447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agggtccaacaattgaaaca

SEQ ID NO: 78448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccataatgttaagggtccaa

SEQ ID NO: 78449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattaccataatgttaaggg

SEQ ID NO: 78450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtctaaattaccataat

SEQ ID NO: 78451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaaaattaaaagtctaaa

SEQ ID NO: 78452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaaaaattaaaagtctaa

SEQ ID NO: 78453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataaaaaattaaaagtcta

SEQ ID NO: 78454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgttttataaaaaattaa

SEQ ID NO: 78455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatgttttataaaaaatta

SEQ ID NO: 78456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaatgttttataaaaaatt

SEQ ID NO: 78457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttcaatgttttataaaaa

SEQ ID NO: 78458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatactattttcaatgttt

SEQ ID NO: 78459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcatactattttcaatgtt

SEQ ID NO: 78460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acacttagcatactattttc

SEQ ID NO: 78461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtctgacacttagcatact

SEQ ID NO: 78462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtctgacacttagcatac

SEQ ID NO: 78463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtctgacacttagcata

SEQ ID NO: 78464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtgtctgacacttagcat

SEQ ID NO: 78465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaatggaaatatcaaacag

SEQ ID NO: 78466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaatggaaatatcaaaca

SEQ ID NO: 78467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgaatggaaatatcaaac

SEQ ID NO: 78468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatgaatggaaatatcaaa

SEQ ID NO: 78469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatgaatggaaatatcaa

SEQ ID NO: 78470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttatgaatggaaatatca

SEQ ID NO: 78471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatttttttatgaatggaaa

SEQ ID NO: 78472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggatttttttatgaatggaa

SEQ ID NO: 78473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttggatttttttatgaatg

SEQ ID NO: 78474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctatttggatttttttatg

SEQ ID NO: 78475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctatttggatttttttat

SEQ ID NO: 78476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggatttgtctatttggatt

SEQ ID NO: 78477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatggatttgtctatttgga

SEQ ID NO: 78478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctctatggatttgtctatt

SEQ ID NO: 78479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctctatggatttgtctat

SEQ ID NO: 78480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatctctatggatttgtcta

SEQ ID NO: 78481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgttttatctctatggattt

SEQ ID NO: 78482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctatgttttatctctatg

SEQ ID NO: 78483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaccactcatctatgttt

SEQ ID NO: 78484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaaaccactcatctatgtt

SEQ ID NO: 78485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccccttggaaaccactcat

SEQ ID NO: 78486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctggccccttggaaaccac

SEQ ID NO: 78487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccctggccccttggaaacc

SEQ ID NO: 78488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctccctggccccttggaaa

SEQ ID NO: 78489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctccctggccccttggaa

SEQ ID NO: 78490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctctccctggccccttg

SEQ ID NO: 78491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttctctccctggcccctt

SEQ ID NO: 78492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatttccttctctccctggc

SEQ ID NO: 78493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caatttccttctctccctgg

SEQ ID NO: 78494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcagtcacttcaatttcctt

SEQ ID NO: 78495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attagcagtcacttcaattt

SEQ ID NO: 78496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tactcattagcagtcacttc

SEQ ID NO: 78497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtactcattagcagtcact

SEQ ID NO: 78498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaaccccaaatagaaactc

SEQ ID NO: 78499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaaccccaaatagaaact

SEQ ID NO: 78500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagaagtttaacaaccccaa

SEQ ID NO: 78501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attagagaagtttaacaacc

SEQ ID NO: 78502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctaattagagaagtttaac

SEQ ID NO: 78503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cgcaacatcaccactaccta

SEQ ID NO: 78504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcgcaacatcaccactacct

SEQ ID NO: 78505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaaacttgcgcaacatcac

SEQ ID NO: 78506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtatattgacaaacttgcg

SEQ ID NO: 78507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtatattgacaaacttgc

SEQ ID NO: 78508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtatattgacaaacttg

SEQ ID NO: 78509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcagtatattgacaaactt

SEQ ID NO: 78510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgtttttcagtatattga

SEQ ID NO: 78511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtatacaattcagtgttt

SEQ ID NO: 78512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtatacaattcagtgtt

SEQ ID NO: 78513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagtatacaattcagtgt

SEQ ID NO: 78514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaattttaaagtatacaat

SEQ ID NO: 78515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaattcacaattttaaag

SEQ ID NO: 78516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatactacaaaattcacaa

SEQ ID NO: 78517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtacaattcaaatactacaa

SEQ ID NO: 78518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttggtacaattcaaatacta

SEQ ID NO: 78519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattggtacaattcaaata

SEQ ID NO: 78520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctattggtacaattcaaat

SEQ ID NO: 78521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctattggtacaattcaaa

SEQ ID NO: 78522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcctattggtacaattcaa

SEQ ID NO: 78523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcctattggtacaattca

SEQ ID NO: 78524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcctattggtacaattc

SEQ ID NO: 78525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttcctattggtacaatt

SEQ ID NO: 78526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctttttttcctattggtaca

SEQ ID NO: 78527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataggtctcctttttttcct

SEQ ID NO: 78528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcataggtctcctttttttc

SEQ ID NO: 78529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcataggtctccttttttt

SEQ ID NO: 78530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctcataggtctccttttt

SEQ ID NO: 78531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcttctcataggtctcct

SEQ ID NO: 78532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcaaagaagactgcctctt

SEQ ID NO: 78533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaaaacattgtgcaaagaa

SEQ ID NO: 78534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctaagaaaacattgtgcaaa

SEQ ID NO: 78535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgctaagaaaacattgtgc

SEQ ID NO: 78536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctgctgctaagaaaacatt

SEQ ID NO: 78537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctacctgctgctaagaaaac

SEQ ID NO: 78538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catctgctacctgctgctaa

SEQ ID NO: 78539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggtcacatatgatggggca

SEQ ID NO: 78540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggtcacatatgatggggc

SEQ ID NO: 78541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaggtcacatatgatgggg

SEQ ID NO: 78542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaggtcacatatgatggg

SEQ ID NO: 78543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttttgaggtcacatatgat

SEQ ID NO: 78544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctccttttgaggtcacata

SEQ ID NO: 78545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catcaggctccctccttttg

SEQ ID NO: 78546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatcaggctccctcctttt

SEQ ID NO: 78547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatcaggctccctccttt

SEQ ID NO: 78548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccatcaggctccctcctt

SEQ ID NO: 78549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttccatcaggctccctcc

SEQ ID NO: 78550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acctcttttccatcaggctc

SEQ ID NO: 78551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctaacctcttttccatcag

SEQ ID NO: 78552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atccctgcctaacctctttt

SEQ ID NO: 78553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catccctgcctaacctcttt

SEQ ID NO: 78554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcatccctgcctaacctc

SEQ ID NO: 78555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatccgattccttcatccc

SEQ ID NO: 78556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaatatccgattccttcat

SEQ ID NO: 78557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agattcctaatatccgattc

SEQ ID NO: 78558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagattcctaatatccgatt

SEQ ID NO: 78559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gacaatacagaagggtctta

SEQ ID NO: 78560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagccacctagacaatacag

SEQ ID NO: 78561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actggagccacctagacaat

SEQ ID NO: 78562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaagtaatccaggttcac

SEQ ID NO: 78563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattatcaaagtaatccagg

SEQ ID NO: 78564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattatcaaagtaatccag

SEQ ID NO: 78565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaattatcaaagtaatcca

SEQ ID NO: 78566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgactttgaattatcaaag

SEQ ID NO: 78567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgttaatgactttgaattat

SEQ ID NO: 78568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccgttaatgactttgaatta

SEQ ID NO: 78569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccgttaatgactttgaatt

SEQ ID NO: 78570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttccgttaatgactttga

SEQ ID NO: 78571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattttccgttaatgacttt

SEQ ID NO: 78572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatattctattttccgttaa

SEQ ID NO: 78573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atatctagatattctatttt

SEQ ID NO: 78574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatctcatatctagatatt

SEQ ID NO: 78575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaatctcatatctagatat

SEQ ID NO: 78576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaatctcatatctagata

SEQ ID NO: 78577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacaatctcatatctagat

SEQ ID NO: 78578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagaaaaatggatttttac

SEQ ID NO: 78579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcagaaaaatggattttta

SEQ ID NO: 78580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaaatgtatttatcagaaa

SEQ ID NO: 78581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccaaatgtatttatcagaa

SEQ ID NO: 78582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccaaatgtatttatcaga

SEQ ID NO: 78583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcccaaatgtatttatcag

SEQ ID NO: 78584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttcccaaatgtatttatc

SEQ ID NO: 78585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcttttcccaaatgtattt

SEQ ID NO: 78586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttactcttttcccaaatgta

SEQ ID NO: 78587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataattgttactcttttccc

SEQ ID NO: 78588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcataattgttactctttt

SEQ ID NO: 78589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcataattgttactcttt

SEQ ID NO: 78590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttattcataattgttact

SEQ ID NO: 78591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttattcataattgttac

SEQ ID NO: 78592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatttattcataattgtta

SEQ ID NO: 78593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagtataattttaatttatt

SEQ ID NO: 78594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattacagtataattttaat

SEQ ID NO: 78595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggaaaatattacattaca

SEQ ID NO: 78596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaggaaaatattacattac

SEQ ID NO: 78597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaggaaaatattacatta

SEQ ID NO: 78598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcaaggaaaatattaca

SEQ ID NO: 78599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttcaaggaaaatattac

SEQ ID NO: 78600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtttattttcaaggaaaat

SEQ ID NO: 78601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatacactcagtttattt

SEQ ID NO: 78602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatacacattatatatacac

SEQ ID NO: 78603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgcattgtatacacattat

SEQ ID NO: 78604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agattaatgcattgtataca

SEQ ID NO: 78605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcctaagattaatgcattg

SEQ ID NO: 78606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaagcctaagattaatgca

SEQ ID NO: 78607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actaagcctaagattaatgc

SEQ ID NO: 78608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttactaagcctaagattaa

SEQ ID NO: 78609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcactgcttactaagcctaa

SEQ ID NO: 78610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaaagagctgtcactgctt

SEQ ID NO: 78611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaaagagctgtcactgct

SEQ ID NO: 78612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatataaaagtatatattt

SEQ ID NO: 78613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattaaaatataaaagtata

SEQ ID NO: 78614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattaaaatataaaagtat

SEQ ID NO: 78615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtattaaaatataaaagta

SEQ ID NO: 78616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtattaaaatataaaagt

SEQ ID NO: 78617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttttgtattaaaatata

SEQ ID NO: 78618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttttgtattaaaatat

SEQ ID NO: 78619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatttttgtattaaaata

SEQ ID NO: 78620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttatatttttgtattaaa

SEQ ID NO: 78621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattattttatatttttgta

SEQ ID NO: 78622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaattattttatattttt

SEQ ID NO: 78623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattattcaattattttata

SEQ ID NO: 78624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctgtattattcaattatt

SEQ ID NO: 78625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattaccctgtattattcaa

SEQ ID NO: 78626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattaccctgtattattca

SEQ ID NO: 78627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatattaccctgtattattc

SEQ ID NO: 78628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttatattaccctgtattat

SEQ ID NO: 78629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatacaagtacagtgctctt

SEQ ID NO: 78630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatacaagtacagtgctct

SEQ ID NO: 78631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatacaagtacagtgctc

SEQ ID NO: 78632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggcctttaaatacaagtac

SEQ ID NO: 78633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taagaagcacacaaaaaact

SEQ ID NO: 78634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatgaataaaacctataa

SEQ ID NO: 78635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaatgaataaaacctata

SEQ ID NO: 78636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaaaaatgaataaaacct

SEQ ID NO: 78637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttaaaaatgaataaaacc

SEQ ID NO: 78638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtttaaaaatgaataaaa

SEQ ID NO: 78639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagttcttgtttaaaaatg

SEQ ID NO: 78640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaagttcttgtttaaaaat

SEQ ID NO: 78641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaagttcttgtttaaaaa

SEQ ID NO: 78642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccaagttcttgtttaaaa

SEQ ID NO: 78643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttccaagttcttgtttaaa

SEQ ID NO: 78644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactttttccaagttcttgt

SEQ ID NO: 78645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acactttttccaagttcttg

SEQ ID NO: 78646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtttacactttttccaagt

SEQ ID NO: 78647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcagtgccaattaggttta

SEQ ID NO: 78648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatggatagtctatgcagtg

SEQ ID NO: 78649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggatggatagtctatgcagt

SEQ ID NO: 78650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcacttggatggatagtct

SEQ ID NO: 78651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgctcagcacttggatgg

SEQ ID NO: 78652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctccatgctcagcacttgga

SEQ ID NO: 78653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctccatgctcagcacttgg

SEQ ID NO: 78654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcatcttcctccatgctca

SEQ ID NO: 78655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agattgatcatcttcctcca

SEQ ID NO: 78656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaggtatgtgacatcattg

SEQ ID NO: 78657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccactcagaggtatgtgaca

SEQ ID NO: 78658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctcccactcagaggtatgt

SEQ ID NO: 78659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaagactatctcccactc

SEQ ID NO: 78660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaaagactatctcccact

SEQ ID NO: 78661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaaaagactatctcccac

SEQ ID NO: 78662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaaaaagactatctccca

SEQ ID NO: 78663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatttttcaaaaagactatc

SEQ ID NO: 78664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataggcaaatactaaatttt

SEQ ID NO: 78665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtcattgataggcaaatact

SEQ ID NO: 78666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgaaagctagtcattgat

SEQ ID NO: 78667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggaaaatggaagctatat

SEQ ID NO: 78668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaggaaaatggaagctata

SEQ ID NO: 78669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatttaaaggaaaatggaag

SEQ ID NO: 78670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagcatggaatgtctgtatt

SEQ ID NO: 78671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagcatggaatgtctgtat

SEQ ID NO: 78672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccagcatggaatgtctgta

SEQ ID NO: 78673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccagcatggaatgtctgt

SEQ ID NO: 78674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttttccagcatggaatgt

SEQ ID NO: 78675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggtctgatttttccagcat

SEQ ID NO: 78676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggggtctgatttttccagc

SEQ ID NO: 78677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caataacagcaaacctctgg

SEQ ID NO: 78678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggcagcacagtgttccaat

SEQ ID NO: 78679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaaaatctcaggcagcaca

SEQ ID NO: 78680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaaaatctcaggcagcac

SEQ ID NO: 78681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaacggcaaatttatgaaaa

SEQ ID NO: 78682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaacggcaaatttatgaaa

SEQ ID NO: 78683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaacggcaaatttatgaa

SEQ ID NO: 78684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaacggcaaatttatga

SEQ ID NO: 78685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgaaacggcaaatttatg

SEQ ID NO: 78686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctttttgaaacggcaaat

SEQ ID NO: 78687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagctttttgaaacggcaaa

SEQ ID NO: 78688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagctttttgaaacggcaa

SEQ ID NO: 78689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cgtaagtactttcagctttt

SEQ ID NO: 78690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcgtaagtactttcagcttt

SEQ ID NO: 78691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcgtaagtactttcagctt

SEQ ID NO: 78692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcgtaagtactttcagct

SEQ ID NO: 78693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttgcgtaagtactttca

SEQ ID NO: 78694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcgtcattgtttttgcgtaa

SEQ ID NO: 78695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcgtcattgtttttgcgta

SEQ ID NO: 78696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcgtcattgtttttgcgt

SEQ ID NO: 78697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gattttgtcgtcattgtttt

SEQ ID NO: 78698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctggattttgtcgtcattg

SEQ ID NO: 78699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtgacccgtggaactggctg

SEQ ID NO: 78700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgtgacccgtggaactggct

SEQ ID NO: 78701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcgtgacccgtggaactgg

SEQ ID NO: 78702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcgtgacccgtggaactg

SEQ ID NO: 78703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttcgtgacccgtggaact

SEQ ID NO: 78704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttcgtgacccgtggaac

SEQ ID NO: 78705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttttcttcgtgacccgtg

SEQ ID NO: 78706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtaggagaattcacttttc

SEQ ID NO: 78707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgtaggagaattcacttt

SEQ ID NO: 78708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgtgtaggagaattcactt

SEQ ID NO: 78709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caagaggcttctgtgtagga

SEQ ID NO: 78710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcaagaggcttctgtgtagg

SEQ ID NO: 78711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaaaatccttgcaagaggc

SEQ ID NO: 78712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaaaaatccttgcaagagg

SEQ ID NO: 78713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatcacttgtaaaaatcctt

SEQ ID NO: 78714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatcacttgtaaaaatcct

SEQ ID NO: 78715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaatcacttgtaaaaatcc

SEQ ID NO: 78716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaatcacttgtaaaaatc

SEQ ID NO: 78717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatatatacttttgaatca

SEQ ID NO: 78718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctggaatatatacttttgaa

SEQ ID NO: 78719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actggaatatatacttttga

SEQ ID NO: 78720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactggaatatatacttttg

SEQ ID NO: 78721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttactggaatatatactttt

SEQ ID NO: 78722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtacacttttactggaata

SEQ ID NO: 78723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtacacttttactggaat

SEQ ID NO: 78724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttaggtacacttttact

SEQ ID NO: 78725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgtttaggtacacttttac

SEQ ID NO: 78726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtatcccaatggaatcttgt

SEQ ID NO: 78727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatctagtatcccaatgga

SEQ ID NO: 78728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacatctagtatcccaatgg

SEQ ID NO: 78729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacatctagtatcccaatg

SEQ ID NO: 78730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcacatctagtatcccaat

SEQ ID NO: 78731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttcacatctagtatccca

SEQ ID NO: 78732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattcttttcacatctagta

SEQ ID NO: 78733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catggtggttgtattctttt

SEQ ID NO: 78734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatggtggttgtattcttt

SEQ ID NO: 78735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagatttacatggtggtt

SEQ ID NO: 78736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagaaaataagttataaaga

SEQ ID NO: 78737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attagagaaaataagttata

SEQ ID NO: 78738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagtggttaattagagaaaa

SEQ ID NO: 78739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccagtggttaattagagaaa

SEQ ID NO: 78740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caatatatgtcttccagtgg

SEQ ID NO: 78741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagggtgtgtccataaccc

SEQ ID NO: 78742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatagggtgtgtccataacc

SEQ ID NO: 78743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtttaatagggtgtgtcc

SEQ ID NO: 78744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgtagtttaatagggtgtg

SEQ ID NO: 78745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatagacctattgtagttta

SEQ ID NO: 78746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggatagacctattgtagtt

SEQ ID NO: 78747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggatagacctattgtagt

SEQ ID NO: 78748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctggatagacctattgtag

SEQ ID NO: 78749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atattttctggatagaccta

SEQ ID NO: 78750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatattttctggatagacct

SEQ ID NO: 78751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatattttctggatagacc

SEQ ID NO: 78752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acattttaatattttctgga

SEQ ID NO: 78753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atattgacattttaatattt

SEQ ID NO: 78754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatattgacattttaatat

SEQ ID NO: 78755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgatattgacattttaata

SEQ ID NO: 78756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggagtgtttctgatattgac

SEQ ID NO: 78757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggagtgtttctgatattg

SEQ ID NO: 78758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgggagtgtttctgatatt

SEQ ID NO: 78759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgggagtgtttctgatat

SEQ ID NO: 78760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttctgggagtgtttctga

SEQ ID NO: 78761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctttctgggagtgtttct

SEQ ID NO: 78762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtacctctgctttctggg

SEQ ID NO: 78763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagtacctctgctttctgg

SEQ ID NO: 78764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcaagtacctctgctttc

SEQ ID NO: 78765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttatttcaagtacctctgc

SEQ ID NO: 78766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agttatttcaagtacctctg

SEQ ID NO: 78767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagttatttcaagtacctc

SEQ ID NO: 78768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattcttagttatttcaagt

SEQ ID NO: 78769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agacctatattcttagttat

SEQ ID NO: 78770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcagatctgagacctatat

SEQ ID NO: 78771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggcagatctgagacctata

SEQ ID NO: 78772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggcagatctgagacctat

SEQ ID NO: 78773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaggcagatctgagaccta

SEQ ID NO: 78774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagaagcaatgtaggaaat

SEQ ID NO: 78775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatagaagcaatgtaggaaa

SEQ ID NO: 78776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatagaagcaatgtaggaa

SEQ ID NO: 78777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgatagaagcaatgtagga

SEQ ID NO: 78778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtgaatttttgatagaagc

SEQ ID NO: 78779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgattgggtgaatttttg

SEQ ID NO: 78780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgattgggtgaattttt

SEQ ID NO: 78781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatgattgggtgaatttt

SEQ ID NO: 78782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatgattgggtgaattt

SEQ ID NO: 78783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgggtgtatttttaaatg

SEQ ID NO: 78784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattatatgggtgtatttt

SEQ ID NO: 78785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataattatatgggtgtattt

SEQ ID NO: 78786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataattatatgggtgtatt

SEQ ID NO: 78787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtgtatgttttataattat

SEQ ID NO: 78788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggtgtatgttttataatta

SEQ ID NO: 78789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgggtgtatgttttataat

SEQ ID NO: 78790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttgggtgtatgttttat

SEQ ID NO: 78791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcttgggtgtatgtttta

SEQ ID NO: 78792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattcttgggtgtatgtttt

SEQ ID NO: 78793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacatattttattcttgggt

SEQ ID NO: 78794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacatgttacacatatttta

SEQ ID NO: 78795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agacatgttacacatatttt

SEQ ID NO: 78796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagacatgttacacatatt

SEQ ID NO: 78797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcttagacatgttacacat

SEQ ID NO: 78798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catcctgttcttagacatgt

SEQ ID NO: 78799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagatgctccatcctgttc

SEQ ID NO: 78800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcagatgctccatcctgtt

SEQ ID NO: 78801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagaatgaacttgtcagat

SEQ ID NO: 78802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaagaatgaacttgtcag

SEQ ID NO: 78803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaaagaatgaacttgtca

SEQ ID NO: 78804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcaaagaatgaacttgtc

SEQ ID NO: 78805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagtgttttctcaaagaatg

SEQ ID NO: 78806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatgctacagtgttttctca

SEQ ID NO: 78807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaaattagatgctacagt

SEQ ID NO: 78808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gattagaaaaattagatgct

SEQ ID NO: 78809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctagattagaaaaattagat

SEQ ID NO: 78810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acctgctagattagaaaaat

SEQ ID NO: 78811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatattaacctgctagatt

SEQ ID NO: 78812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatgatattaacctgctaga

SEQ ID NO: 78813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctatgatattaacctgct

SEQ ID NO: 78814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctcctctatgatattaacc

SEQ ID NO: 78815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctcctctatgatattaac

SEQ ID NO: 78816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacctcctctatgatattaa

SEQ ID NO: 78817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttacctcctctatgatatt

SEQ ID NO: 78818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctttacctcctctatgat

SEQ ID NO: 78819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttctttacctcctctatga

SEQ ID NO: 78820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttctttacctcctctatg

SEQ ID NO: 78821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgttctttacctcctctat

SEQ ID NO: 78822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgttctttacctcctct

SEQ ID NO: 78823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttgttctttacctcctc

SEQ ID NO: 78824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttgttctttacctcct

SEQ ID NO: 78825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttttgttctttacctcc

SEQ ID NO: 78826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttcttttgttctttacc

SEQ ID NO: 78827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcttttcttttgttctttac

SEQ ID NO: 78828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgcttgcttttcttttgt

SEQ ID NO: 78829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccatgttatatgcttgcttt

SEQ ID NO: 78830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccatgttatatgcttgctt

SEQ ID NO: 78831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttcccatgttatatgctt

SEQ ID NO: 78832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accttcccatgttatatgct

SEQ ID NO: 78833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taccttcccatgttatatgc

SEQ ID NO: 78834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaagatggggaatctttac

SEQ ID NO: 78835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaagatggggaatcttta

SEQ ID NO: 78836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catttatgaagatggggaat

SEQ ID NO: 78837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgcatttatgaagatgggg

SEQ ID NO: 78838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaggaagttactgcattta

SEQ ID NO: 78839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgccaggaagttactgcat

SEQ ID NO: 78840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgccaggaagttactgca

SEQ ID NO: 78841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgccaggaagttactgc

SEQ ID NO: 78842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcctgccaggaagttactg

SEQ ID NO: 78843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttttcctgccaggaagtta

SEQ ID NO: 78844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttttcctgccaggaagtt

SEQ ID NO: 78845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccttttcctgccaggaagt

SEQ ID NO: 78846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcctttccttttcctgcca

SEQ ID NO: 78847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcctttccttttcctgcc

SEQ ID NO: 78848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatttcatcctttcctttt

SEQ ID NO: 78849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtattatcatttcatccttt

SEQ ID NO: 78850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtattatcatttcatcctt

SEQ ID NO: 78851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtattatcatttcatcct

SEQ ID NO: 78852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatagttttggtattatca

SEQ ID NO: 78853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatatagttttggtattatc

SEQ ID NO: 78854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatatagttttggtattat

SEQ ID NO: 78855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaccaaaaatgtcgagtaag

SEQ ID NO: 78856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaccatgaataacccaccg

SEQ ID NO: 78857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaccatgaataacccacc

SEQ ID NO: 78858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catatttatgaccatgaata

SEQ ID NO: 78859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acaaactgcatatttatgac

SEQ ID NO: 78860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgacaaactgcatatttatg

SEQ ID NO: 78861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctgacaaactgcatattt

SEQ ID NO: 78862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcatgtgcactattctgac

SEQ ID NO: 78863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcatgctcatcatgtgcac

SEQ ID NO: 78864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcagcatgctcatcatgtg

SEQ ID NO: 78865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcagcatgctcatcatgt

SEQ ID NO: 78866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccttattcagcatgctcatc

SEQ ID NO: 78867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agctaccttattcagcatgc

SEQ ID NO: 78868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagctaccttattcagcat

SEQ ID NO: 78869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attctaagctaccttattca

SEQ ID NO: 78870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gattctaagctaccttattc

SEQ ID NO: 78871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgattctaagctacctta

SEQ ID NO: 78872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttccttgattctaagctacc

SEQ ID NO: 78873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttccttgattctaagctac

SEQ ID NO: 78874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttccttgattctaagcta

SEQ ID NO: 78875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgttccttgattctaagct

SEQ ID NO: 78876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttgttccttgattctaag

SEQ ID NO: 78877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcgtctcttttgttccttga

SEQ ID NO: 78878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccactgtcgtctcttttgtt

SEQ ID NO: 78879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaattcccactgtcgtctct

SEQ ID NO: 78880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaattcccactgtcgtctc

SEQ ID NO: 78881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatatttcaaattcccact

SEQ ID NO: 78882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacaagtgtcatcctcaaat

SEQ ID NO: 78883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacaagtgtcatcctcaaa

SEQ ID NO: 78884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagcatttcaacaagtgtc

SEQ ID NO: 78885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaaaagttgtaagcatttc

SEQ ID NO: 78886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggaaaagttgtaagcattt

SEQ ID NO: 78887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaggaaaagttgtaagcat

SEQ ID NO: 78888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaggaaaagttgtaagca

SEQ ID NO: 78889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttaggaaaagttgtaagc

SEQ ID NO: 78890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttaggaaaagttgtaag

SEQ ID NO: 78891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttaggaaaagttgtaa

SEQ ID NO: 78892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcttaggaaaagttgta

SEQ ID NO: 78893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatttttttcttaggaaaa

SEQ ID NO: 78894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaatttttttcttaggaaa

SEQ ID NO: 78895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttagaatttttttcttag

SEQ ID NO: 78896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caagctcatttagaattttt

SEQ ID NO: 78897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagagacaaaatagtctac

SEQ ID NO: 78898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcaaagagacaaaatagtc

SEQ ID NO: 78899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttcaaagagacaaaatagt

SEQ ID NO: 78900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgttcaaagagacaaaata

SEQ ID NO: 78901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttgttcaaagagacaaaa

SEQ ID NO: 78902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctcttgttcaaagagaca

SEQ ID NO: 78903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactctcttgttcaaagag

SEQ ID NO: 78904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attactctcttgttcaaaga

SEQ ID NO: 78905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttattactctcttgttcaa

SEQ ID NO: 78906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttattactctcttgttca

SEQ ID NO: 78907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttattactctcttgttc

SEQ ID NO: 78908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatttattactctcttgtt

SEQ ID NO: 78909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttttatttattactctctt

SEQ ID NO: 78910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggatatgttacttttattta

SEQ ID NO: 78911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggatatgttacttttattt

SEQ ID NO: 78912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggatatgttacttttatt

SEQ ID NO: 78913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agattttaggatatgttact

SEQ ID NO: 78914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggagagtggcaatattaaga

SEQ ID NO: 78915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagaagactgggagagtgg

SEQ ID NO: 78916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatgggtctcagagaagac

SEQ ID NO: 78917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcatgggtctcagagaaga

SEQ ID NO: 78918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atataatttgtcatgggtct

SEQ ID NO: 78919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaatataatttgtcatggg

SEQ ID NO: 78920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtattattaatataatttg

SEQ ID NO: 78921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtattattaatataattt

SEQ ID NO: 78922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttcagtattattaatata

SEQ ID NO: 78923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaatttcagtattattaat

SEQ ID NO: 78924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaatttcagtattattaa

SEQ ID NO: 78925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttattaatttcagtatta

SEQ ID NO: 78926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttattaatttcagtatt

SEQ ID NO: 78927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtttattaatttcagtat

SEQ ID NO: 78928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttttagtttattaatttca

SEQ ID NO: 78929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggttttagtttattaattt

SEQ ID NO: 78930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagactctggttttagttt

SEQ ID NO: 78931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaagactctggttttagtt

SEQ ID NO: 78932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caccttgaaagactctggtt

SEQ ID NO: 78933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaccttgaaagactctggt

SEQ ID NO: 78934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcaccttgaaagactctgg

SEQ ID NO: 78935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgcaccttgaaagactctg

SEQ ID NO: 78936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taccttttgcaccttgaaag

SEQ ID NO: 78937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatatagatgttatacctt

SEQ ID NO: 78938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaaatatagatgttatac

SEQ ID NO: 78939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcaaatatagatgttata

SEQ ID NO: 78940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattcaaatatagatgttat

SEQ ID NO: 78941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttattcaaatatagatgt

SEQ ID NO: 78942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctattttattcaaatataga

SEQ ID NO: 78943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctattttattcaaatatag

SEQ ID NO: 78944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctattttattcaaatata

SEQ ID NO: 78945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgctattttattcaaatat

SEQ ID NO: 78946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtgtaatttttgctattt

SEQ ID NO: 78947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggtgtaatttttgctatt

SEQ ID NO: 78948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatggtgtaatttttgctat

SEQ ID NO: 78949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catccagtggcactttatgg

SEQ ID NO: 78950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatgattacatccagtgg

SEQ ID NO: 78951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaatgattacatccagtg

SEQ ID NO: 78952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaatgattacatccagt

SEQ ID NO: 78953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaaatgattacatccag

SEQ ID NO: 78954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atatccttttaaaaatgatt

SEQ ID NO: 78955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtacactcatatccttttaa

SEQ ID NO: 78956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtacactcatatcctttta

SEQ ID NO: 78957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtacactcatatcctttt

SEQ ID NO: 78958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agattttagtacactcatat

SEQ ID NO: 78959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaagattttagtacactca

SEQ ID NO: 78960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaagaatatctattaagat

SEQ ID NO: 78961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagaagaatatctattaag

SEQ ID NO: 78962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtcctctaagaagaatatc

SEQ ID NO: 78963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtcctctaagaagaatat

SEQ ID NO: 78964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagtcctctaagaagaata

SEQ ID NO: 78965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctttcagtcctctaagaaga

SEQ ID NO: 78966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctttcagtcctctaagaa

SEQ ID NO: 78967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcctttcagtcctctaaga

SEQ ID NO: 78968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcctttcagtcctctaag

SEQ ID NO: 78969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatgctttctcctttcag

SEQ ID NO: 78970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatatgctttctcctttca

SEQ ID NO: 78971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatatatgctttctcctttc

SEQ ID NO: 78972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttatatatgctttctcct

SEQ ID NO: 78973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgccacacctgctttata

SEQ ID NO: 78974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatgccacacctgctttat

SEQ ID NO: 78975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgtttcaatgccacacctgc

SEQ ID NO: 78976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccgtttcaatgccacacctg

SEQ ID NO: 78977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacaaagggaaaacaatctt

SEQ ID NO: 78978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagtattgaacaaagggaa

SEQ ID NO: 78979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catagtattgaacaaaggga

SEQ ID NO: 78980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatagtattgaacaaaggg

SEQ ID NO: 78981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagactttcatagtattgaa

SEQ ID NO: 78982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcagactttcatagtatt

SEQ ID NO: 78983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcctgcagactttcatagt

SEQ ID NO: 78984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcctgcagactttcatag

SEQ ID NO: 78985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctcctgcagactttcata

SEQ ID NO: 78986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcctcctgcagactttcat

SEQ ID NO: 78987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcctcctgcagactttca

SEQ ID NO: 78988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttcctcctgcagacttt

SEQ ID NO: 78989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttcctcctgcagactt

SEQ ID NO: 78990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctttttcctcctgcagact

SEQ ID NO: 78991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcctttctttttcctcctg

SEQ ID NO: 78992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcctttctttttcctcct

SEQ ID NO: 78993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatttcatcctttctttttc

SEQ ID NO: 78994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaatttcatcctttctttt

SEQ ID NO: 78995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattctcaatttcatccttt

SEQ ID NO: 78996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggattctcaatttcatcctt

SEQ ID NO: 78997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggattctcaatttcatcct

SEQ ID NO: 78998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atattttggattctcaattt

SEQ ID NO: 78999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtgaaaaattgatatttt

SEQ ID NO: 79000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atattgatgtgaaaaattga

SEQ ID NO: 79001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgatattgatgtgaaaaat

SEQ ID NO: 79002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccatgtagaaaggtaaactg

SEQ ID NO: 79003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatataacactgccatgtag

SEQ ID NO: 79004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caatataacactgccatgta

SEQ ID NO: 79005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcaatataacactgccatg

SEQ ID NO: 79006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcaatataacactgccat

SEQ ID NO: 79007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggcagtgtttcttcaata

SEQ ID NO: 79008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtctgatggcagtgtttc

SEQ ID NO: 79009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctggagtctgatggcagtgt

SEQ ID NO: 79010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaccacattgctggagtct

SEQ ID NO: 79011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgacattggaaccacattg

SEQ ID NO: 79012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagatgcgttgatgacatt

SEQ ID NO: 79013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccaaggtgacattgataga

SEQ ID NO: 79014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggccaaggtgacattga

SEQ ID NO: 79015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagttcattggccaaggtga

SEQ ID NO: 79016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggagttcattggccaaggtg

SEQ ID NO: 79017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaagaagtggacttggagt

SEQ ID NO: 79018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatgaagaagtggacttgg

SEQ ID NO: 79019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagttactatgaagaagtgg

SEQ ID NO: 79020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagttactatgaagaagtg

SEQ ID NO: 79021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagttactatgaagaagt

SEQ ID NO: 79022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaagttactatgaagaag

SEQ ID NO: 79023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatttttaaagttactatga

SEQ ID NO: 79024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acaaatagctcaatttttaa

SEQ ID NO: 79025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcaatacatgctaacaaat

SEQ ID NO: 79026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagcaatacatgctaacaa

SEQ ID NO: 79027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagctctaagcaatacatg

SEQ ID NO: 79028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagctctaagcaatacat

SEQ ID NO: 79029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaagctctaagcaataca

SEQ ID NO: 79030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgaaagaaaatgaaaaata

SEQ ID NO: 79031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctggtgaaagaaaatgaaaa

SEQ ID NO: 79032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttactggtgaaagaaaatga

SEQ ID NO: 79033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgttactggtgaaagaaaa

SEQ ID NO: 79034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accacagttattgttactgg

SEQ ID NO: 79035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaccacagttattgttactg

SEQ ID NO: 79036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataacttaaccacagtta

SEQ ID NO: 79037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaataacttaaccacagtt

SEQ ID NO: 79038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaataacttaaccacagt

SEQ ID NO: 79039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactttaaaataacttaacc

SEQ ID NO: 79040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgcagtgtaatggaagg

SEQ ID NO: 79041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaatgcagtgtaatggaag

SEQ ID NO: 79042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaaatgcagtgtaatgga

SEQ ID NO: 79043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaaaatgcagtgtaatgg

SEQ ID NO: 79044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttaaaatgcagtgtaatg

SEQ ID NO: 79045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctttcttaaaatgcagtgt

SEQ ID NO: 79046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctttcttaaaatgcagtg

SEQ ID NO: 79047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttggctttcttaaaatgca

SEQ ID NO: 79048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatttggctttcttaaaatg

SEQ ID NO: 79049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatttggctttcttaaaat

SEQ ID NO: 79050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttctatttggctttctta

SEQ ID NO: 79051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagatagctagtttctattt

SEQ ID NO: 79052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgataaaaatattagagata

SEQ ID NO: 79053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgataaaaatattagagat

SEQ ID NO: 79054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgataaaaatattagaga

SEQ ID NO: 79055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaggttttatgataaaaata

SEQ ID NO: 79056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaggttttatgataaaaa

SEQ ID NO: 79057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattctcaaggttttatga

SEQ ID NO: 79058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccagcaagtattaaaattct

SEQ ID NO: 79059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
accataacaattgccagcaa

SEQ ID NO: 79060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctaaccataacaattgccag

SEQ ID NO: 79061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaacatgtgctgctaaccat

SEQ ID NO: 79062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaacatgtgctgctaacca

SEQ ID NO: 79063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaacatgtgctgctaacc

SEQ ID NO: 79064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atattttggaacatgtgctg

SEQ ID NO: 79065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaataactcatattttggaa

SEQ ID NO: 79066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaataactcatattttgga

SEQ ID NO: 79067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaataactcatattttgg

SEQ ID NO: 79068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaataactcatattttg

SEQ ID NO: 79069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgaaataactcatatttt

SEQ ID NO: 79070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaaaatattttttgaaata

SEQ ID NO: 79071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggaaaatattttttgaaat

SEQ ID NO: 79072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacttaggaaaatatttttt

SEQ ID NO: 79073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caacttaggaaaatattttt

SEQ ID NO: 79074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcaacttaggaaaatatt

SEQ ID NO: 79075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acgttccttcaacttaggaa

SEQ ID NO: 79076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgacgttccttcaacttagg

SEQ ID NO: 79077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caactctgacgttccttcaa

SEQ ID NO: 79078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaactctgacgttccttca

SEQ ID NO: 79079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccaactctgacgttcctt

SEQ ID NO: 79080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaggattcttccaactctg

SEQ ID NO: 79081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtgattggaaggattcttc

SEQ ID NO: 79082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactcagtgattggaaggat

SEQ ID NO: 79083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaataaagaaattgaactca

SEQ ID NO: 79084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taactaaaataaagaaattg

SEQ ID NO: 79085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtattataactaaaataaag

SEQ ID NO: 79086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atattagtattataactaaa

SEQ ID NO: 79087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagctaatattagtattat

SEQ ID NO: 79088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagctaatattagtatta

SEQ ID NO: 79089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaagctaatattagtatt

SEQ ID NO: 79090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaagctaatattagtat

SEQ ID NO: 79091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtcccttttaaaagctaat

SEQ ID NO: 79092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtcccttttaaaagctaa

SEQ ID NO: 79093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttaagtcccttttaaaag

SEQ ID NO: 79094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatttaagtcccttttaaaa

SEQ ID NO: 79095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaatttaagtcccttttaa

SEQ ID NO: 79096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaagtgaggaatcctctta

SEQ ID NO: 79097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccgtggttagtaagtgagga

SEQ ID NO: 79098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaccgtggttagtaagt

SEQ ID NO: 79099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattaccgtggttagtaag

SEQ ID NO: 79100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaattaccgtggttagtaa

SEQ ID NO: 79101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaattaccgtggttagta

SEQ ID NO: 79102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaattaccgtggttagt

SEQ ID NO: 79103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatcgttttttaaattacc

SEQ ID NO: 79104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcatatcgttttttaaatt

SEQ ID NO: 79105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattcatatcgttttttaaa

SEQ ID NO: 79106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctattcatatcgttttttaa

SEQ ID NO: 79107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttctattcatatcgttttt

SEQ ID NO: 79108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttctattcatatcgtttt

SEQ ID NO: 79109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagaatgtttgcttctattc

SEQ ID NO: 79110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagaatgtttgcttctatt

SEQ ID NO: 79111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caataacatttcaagaatgt

SEQ ID NO: 79112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggaatggctacaataacat

SEQ ID NO: 79113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atggaatggctacaataaca

SEQ ID NO: 79114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggaaaaggacacttatgga

SEQ ID NO: 79115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagctatggaaaaggacact

SEQ ID NO: 79116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatactaaagctatggaaaa

SEQ ID NO: 79117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actgaatactaaagctatgg

SEQ ID NO: 79118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aactgaatactaaagctatg

SEQ ID NO: 79119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaactgaatactaaagcta

SEQ ID NO: 79120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaactgaatactaaagct

SEQ ID NO: 79121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcttaactgaatactaaa

SEQ ID NO: 79122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcttaactgaatactaa

SEQ ID NO: 79123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttcttaactgaatacta

SEQ ID NO: 79124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttcttaactgaatact

SEQ ID NO: 79125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttatttcttaactgaat

SEQ ID NO: 79126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttgtttttatttcttaact

SEQ ID NO: 79127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctggttgtttttatttctta

SEQ ID NO: 79128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgctggttgtttttatttc

SEQ ID NO: 79129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttactgctggttgtttttat

SEQ ID NO: 79130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgttactgctggttgtttt

SEQ ID NO: 79131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgttactgctggttgttt

SEQ ID NO: 79132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgttactgctggttgtt

SEQ ID NO: 79133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atattttgttgttactgctg

SEQ ID NO: 79134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatattttgttgttactgct

SEQ ID NO: 79135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatattttgttgttactgc

SEQ ID NO: 79136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttaatattttgttgttac

SEQ ID NO: 79137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggttgctttaatattttgtt

SEQ ID NO: 79138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggttgctttaatattttgt

SEQ ID NO: 79139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taggttgctttaatattttg

SEQ ID NO: 79140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agccaatgctttaggttgct

SEQ ID NO: 79141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagccaatgctttaggttg

SEQ ID NO: 79142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaagccaatgctttaggtt

SEQ ID NO: 79143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttctaagccaatgcttta

SEQ ID NO: 79144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatttctaagccaatgctt

SEQ ID NO: 79145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgatttctaagccaatgct

SEQ ID NO: 79146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgatttctaagccaatgc

SEQ ID NO: 79147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctttctgatttctaagcca

SEQ ID NO: 79148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctttctgatttctaagcc

SEQ ID NO: 79149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtctttctgatttctaagc

SEQ ID NO: 79150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactttgtctttctgatttc

SEQ ID NO: 79151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaactttgtctttctgattt

SEQ ID NO: 79152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggatttgaactttgtctttc

SEQ ID NO: 79153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaaccggagaaaaataagg

SEQ ID NO: 79154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgccaaccggagaaaaata

SEQ ID NO: 79155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgccaaccggagaaaaat

SEQ ID NO: 79156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acacaagtcatcttcctgcc

SEQ ID NO: 79157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctaacacaagtcatcttc

SEQ ID NO: 79158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagctaacacaagtcatctt

SEQ ID NO: 79159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagctaacacaagtcatct

SEQ ID NO: 79160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaagtcagtgtctttcagc

SEQ ID NO: 79161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaagtcagtgtctttcag

SEQ ID NO: 79162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataaaatttagaaagtcag

SEQ ID NO: 79163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataaccctatataaaattta

SEQ ID NO: 79164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccagaaacccactgataacc

SEQ ID NO: 79165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgccagaaacccactgata

SEQ ID NO: 79166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgccagaaacccactgat

SEQ ID NO: 79167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatacggtgagaaatgctta

SEQ ID NO: 79168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgaatacggtgagaaatgc

SEQ ID NO: 79169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctcctgaatacggtgagaa

SEQ ID NO: 79170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acctcctgaatacggtgaga

SEQ ID NO: 79171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acagacttacctcctgaata

SEQ ID NO: 79172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actcacagacttacctcctg

SEQ ID NO: 79173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccgcatacaaataaaaagcc

SEQ ID NO: 79174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agggaacgctgccgcataca

SEQ ID NO: 79175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagggaacgctgccgcatac

SEQ ID NO: 79176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgagggaacgctgccgcat

SEQ ID NO: 79177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgagggaacgctgccgca

SEQ ID NO: 79178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgagggaacgctgccgc

SEQ ID NO: 79179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttcttgagggaacgctgc

SEQ ID NO: 79180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttcttgagggaacgctg

SEQ ID NO: 79181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttgttttcttgagggaac

SEQ ID NO: 79182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatttgttttcttgaggga

SEQ ID NO: 79183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaacaatagactctgattt

SEQ ID NO: 79184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atacagtgaaagggagcagg

SEQ ID NO: 79185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatagaactgatacagtgaa

SEQ ID NO: 79186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatagaactgatacagtga

SEQ ID NO: 79187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttagatagaactgatac

SEQ ID NO: 79188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgtatttagatagaact

SEQ ID NO: 79189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattaaattgtatttagata

SEQ ID NO: 79190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattaaattgtatttagat

SEQ ID NO: 79191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacattaaattgtatttaga

SEQ ID NO: 79192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgtaaaagtgaattttac

SEQ ID NO: 79193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatgtaaaagtgaatttta

SEQ ID NO: 79194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatgtaaaagtgaatttt

SEQ ID NO: 79195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataattttccatgtaaaa

SEQ ID NO: 79196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaataattttccatgtaaa

SEQ ID NO: 79197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaataattttccatgtaa

SEQ ID NO: 79198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttaaaataattttccat

SEQ ID NO: 79199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtattaattttaaaataat

SEQ ID NO: 79200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggactaggtattaatttta

SEQ ID NO: 79201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggactaggtattaatttt

SEQ ID NO: 79202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacttgaggactaggtatta

SEQ ID NO: 79203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agacaaaaaggattgtactt

SEQ ID NO: 79204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagacaaaaaggattgtact

SEQ ID NO: 79205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatttaagacaaaaaggat

SEQ ID NO: 79206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgagatttaagacaaaaag

SEQ ID NO: 79207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatacagtctactgagat

SEQ ID NO: 79208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaatacagtctactgaga

SEQ ID NO: 79209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaatacagtctactgag

SEQ ID NO: 79210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaatacagtctactga

SEQ ID NO: 79211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaaatacagtctactg

SEQ ID NO: 79212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagaaagaatggatgaataa

SEQ ID NO: 79213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggcggggacacagagccaaa

SEQ ID NO: 79214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggcggggacacagagccaa

SEQ ID NO: 79215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatgagatttgggcgggg

SEQ ID NO: 79216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caattcaaaatgagatttgg

SEQ ID NO: 79217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agacgtggggattacaattc

SEQ ID NO: 79218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccctgagacgtggggattac

SEQ ID NO: 79219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaccaggtccctcccctga

SEQ ID NO: 79220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accaccaggtccctcccctg

SEQ ID NO: 79221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccatgatccaatcacttacc

SEQ ID NO: 79222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggaaaccgctcccatgatc

SEQ ID NO: 79223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcatgagaacagcactgggg

SEQ ID NO: 79224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actatcatgagaacagcact

SEQ ID NO: 79225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actcactatcatgagaacag

SEQ ID NO: 79226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actcactcactatcatgaga

SEQ ID NO: 79227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgagaactcactcactcac

SEQ ID NO: 79228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacccatcagatctcatgag

SEQ ID NO: 79229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacccatcagatctcatga

SEQ ID NO: 79230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaacccatcagatctcatg

SEQ ID NO: 79231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaacccatcagatctcat

SEQ ID NO: 79232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatggtgcaggagagggag

SEQ ID NO: 79233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacatggtgcaggagaggga

SEQ ID NO: 79234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatcatggtcgaaggcaaa

SEQ ID NO: 79235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaatcatggtcgaaggcaa

SEQ ID NO: 79236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaaaacttacaatcatggt

SEQ ID NO: 79237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatggcaggggaggcctcag

SEQ ID NO: 79238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaatggcaggggaggcctc

SEQ ID NO: 79239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctgaatggcaggggaggc

SEQ ID NO: 79240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgttctgaatggcagggg

SEQ ID NO: 79241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcactgttctgaatggcag

SEQ ID NO: 79242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcactgttctgaatggca

SEQ ID NO: 79243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttactcactgttctgaat

SEQ ID NO: 79244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttactcactgttctgaa

SEQ ID NO: 79245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagaaaagagatttaatt

SEQ ID NO: 79246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaagaaaagagatttaat

SEQ ID NO: 79247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtaatttataaagaaaaga

SEQ ID NO: 79248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agactgggtaatttataaag

SEQ ID NO: 79249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctgagactgggtaatttat

SEQ ID NO: 79250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaagaactacctgagactg

SEQ ID NO: 79251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctataaagaactacctgaga

SEQ ID NO: 79252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactgctataaagaactacc

SEQ ID NO: 79253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acactgctataaagaactac

SEQ ID NO: 79254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacactgctataaagaacta

SEQ ID NO: 79255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacactgctataaagaact

SEQ ID NO: 79256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtccatttttacactgctat

SEQ ID NO: 79257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaacacaggcgtgagccac

SEQ ID NO: 79258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaagtgctgggaacacag

SEQ ID NO: 79259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcctcccaaagtgctgggaa

SEQ ID NO: 79260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcctcccaaagtgctggga

SEQ ID NO: 79261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccaccttggcctcccaaag

SEQ ID NO: 79262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcccaccttggcctcccaa

SEQ ID NO: 79263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttctgcccaccttggcct

SEQ ID NO: 79264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acgttgtgttctgcccacct

SEQ ID NO: 79265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgacgttgtgttctgccca

SEQ ID NO: 79266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gatctcctgacgttgtgttc

SEQ ID NO: 79267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccaggatggtctcgatctc

SEQ ID NO: 79268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accgtgttagccaggatggt

SEQ ID NO: 79269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagagacggggattcaccg

SEQ ID NO: 79270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagagacggggattcacc

SEQ ID NO: 79271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagagacggggattcac

SEQ ID NO: 79272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtagagacggggattca

SEQ ID NO: 79273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttagtagagacgggg

SEQ ID NO: 79274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttttagtagagacggg

SEQ ID NO: 79275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatttttagtagagacgg

SEQ ID NO: 79276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtatttttagtagagacg

SEQ ID NO: 79277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttgtatttttagtagag

SEQ ID NO: 79278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttgtatttttagtaga

SEQ ID NO: 79279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttttgtatttttagtag

SEQ ID NO: 79280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttgtttttgtattttta

SEQ ID NO: 79281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctaattttgtttttgtatt

SEQ ID NO: 79282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caggtacccgccaccacacc

SEQ ID NO: 79283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggactacaggtacccgccac

SEQ ID NO: 79284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagggtagctgggactacag

SEQ ID NO: 79285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctccagggtagctggga

SEQ ID NO: 79286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccacctcagcctccagggta

SEQ ID NO: 79287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccacctcagcctccaggg

SEQ ID NO: 79288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acgccattctcccacctcag

SEQ ID NO: 79289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccgggttcacgccattctcc

SEQ ID NO: 79290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgcctcccgggttcacgcca

SEQ ID NO: 79291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caagctccgcctcccgggtt

SEQ ID NO: 79292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgcaagctccgcctcccg

SEQ ID NO: 79293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcactgcaagctccgcct

SEQ ID NO: 79294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctcactgcaagctccgcc

SEQ ID NO: 79295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggctcactgcaagctccgc

SEQ ID NO: 79296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtgccgtggcgcgatttt

SEQ ID NO: 79297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccaggctggagtgccgtgg

SEQ ID NO: 79298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgcccaggctggagtgccg

SEQ ID NO: 79299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttgcccaggctggagtgc

SEQ ID NO: 79300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctctgttgcccaggctgga

SEQ ID NO: 79301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacagagtctccctctgtt

SEQ ID NO: 79302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagacagagtctccctctgt

SEQ ID NO: 79303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagacagagtctccctctg

SEQ ID NO: 79304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagacagagtctccctct

SEQ ID NO: 79305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagacagagtctccctc

SEQ ID NO: 79306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgagacagagtctccct

SEQ ID NO: 79307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgagacagagtctccc

SEQ ID NO: 79308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgagacagagtctcc

SEQ ID NO: 79309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttgagacagagtctc

SEQ ID NO: 79310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttgagacagagtct

SEQ ID NO: 79311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttgagacagagtc

SEQ ID NO: 79312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttgagacagagt

SEQ ID NO: 79313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttgagacagag

SEQ ID NO: 79314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttgagacaga

SEQ ID NO: 79315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttgagacag

SEQ ID NO: 79316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttgagaca

SEQ ID NO: 79317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttgagac

SEQ ID NO: 79318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttttgaga

SEQ ID NO: 79319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttgag

SEQ ID NO: 79320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttttttttttttttga

SEQ ID NO: 79321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcttttttttttttttttt

SEQ ID NO: 79322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacatgtattagtctttttt

SEQ ID NO: 79323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actatacatgtattagtctt

SEQ ID NO: 79324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgactatacatgtattagtc

SEQ ID NO: 79325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgactatacatgtattagt

SEQ ID NO: 79326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatatagtttctgactata

SEQ ID NO: 79327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatgatatagtttctgact

SEQ ID NO: 79328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgttatgatatagtttct

SEQ ID NO: 79329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attacctgttatgatatagt

SEQ ID NO: 79330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattacctgttatgatatag

SEQ ID NO: 79331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattacctgttatgatata

SEQ ID NO: 79332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcattacctgttatgatat

SEQ ID NO: 79333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttttcattacctgttatga

SEQ ID NO: 79334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaactccttttcattacctg

SEQ ID NO: 79335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcaaactccttttcattac

SEQ ID NO: 79336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttcaaactccttttcatta

SEQ ID NO: 79337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttcaaactccttttcatt

SEQ ID NO: 79338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttcaaactccttttcat

SEQ ID NO: 79339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttgttcaaactcctttt

SEQ ID NO: 79340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttttgttcaaactccttt

SEQ ID NO: 79341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgccttatttttgttcaaa

SEQ ID NO: 79342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatacaaaactcatgcctta

SEQ ID NO: 79343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatacaaaactcatgcctt

SEQ ID NO: 79344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgaatacaaaactcatgc

SEQ ID NO: 79345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggaagttccttgaatacaaa

SEQ ID NO: 79346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggaagttccttgaataca

SEQ ID NO: 79347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaggaagttccttgaatac

SEQ ID NO: 79348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaggaagttccttgaata

SEQ ID NO: 79349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctaggaagttccttgaat

SEQ ID NO: 79350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttctaggaagttcctt

SEQ ID NO: 79351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttttctaggaagttcct

SEQ ID NO: 79352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatttttctaggaagttcc

SEQ ID NO: 79353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcatttttctaggaagttc

SEQ ID NO: 79354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttcatttttctaggaagt

SEQ ID NO: 79355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttcatttttctaggaag

SEQ ID NO: 79356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttttcatttttctagga

SEQ ID NO: 79357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcttttcatttttctagg

SEQ ID NO: 79358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttcttttcatttttctag

SEQ ID NO: 79359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttcttcttttcatttttc

SEQ ID NO: 79360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttactttcttcttttcatt

SEQ ID NO: 79361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattagttactttcttcttt

SEQ ID NO: 79362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atattagttactttcttctt

SEQ ID NO: 79363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccttatattagttactttct

SEQ ID NO: 79364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccttatattagttactttc

SEQ ID NO: 79365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcacatcttgccttatatta

SEQ ID NO: 79366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatgatatctgtcacatctt

SEQ ID NO: 79367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtatgatatctgtcacatc

SEQ ID NO: 79368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtatgatatctgtcacat

SEQ ID NO: 79369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtatgatatctgtcaca

SEQ ID NO: 79370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgtatgatatctgtcac

SEQ ID NO: 79371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttttctgtatgatatct

SEQ ID NO: 79372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttttctgtatgatatc

SEQ ID NO: 79373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatatttttctgtatgatat

SEQ ID NO: 79374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccctttatatttttctgta

SEQ ID NO: 79375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccccctttatatttttctgt

SEQ ID NO: 79376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccccctttatatttttct

SEQ ID NO: 79377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attcttccccctttatattt

SEQ ID NO: 79378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcattcttccccctttatat

SEQ ID NO: 79379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actctcattcttcccccttt

SEQ ID NO: 79380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cactctcattcttccccctt

SEQ ID NO: 79381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcactctcattcttccccc

SEQ ID NO: 79382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctcttcactctcattcttc

SEQ ID NO: 79383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttccctcttcactctcattc

SEQ ID NO: 79384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagtcatgtgaccctgttc

SEQ ID NO: 79385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacagtcatgtgaccctgtt

SEQ ID NO: 79386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacagtcatgtgaccctgt

SEQ ID NO: 79387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataattttgacagtcatgtg

SEQ ID NO: 79388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctgataattttgacagtca

SEQ ID NO: 79389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagtctccctgataattt

SEQ ID NO: 79390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaagtctccctgataatt

SEQ ID NO: 79391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cggtttataaagtctccctg

SEQ ID NO: 79392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agatgacctccggtttataa

SEQ ID NO: 79393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctcagatgacctccggttt

SEQ ID NO: 79394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgttagctcagatgacctc

SEQ ID NO: 79395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgttagctcagatgacct

SEQ ID NO: 79396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgttagctcagatgacc

SEQ ID NO: 79397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatgttagctcagatgac

SEQ ID NO: 79398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatttttcatgttagctca

SEQ ID NO: 79399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtagtatgttgtgattttt

SEQ ID NO: 79400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaatactatgtagtatgtt

SEQ ID NO: 79401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccaatactatgtagtatgt

SEQ ID NO: 79402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcttgccaatactatgtag

SEQ ID NO: 79403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatcttgccaatactatgta

SEQ ID NO: 79404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtataaggtaacttgatc

SEQ ID NO: 79405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagtataaggtaacttgat

SEQ ID NO: 79406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatttcaagtataaggtaa

SEQ ID NO: 79407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaaatttcaagtataagg

SEQ ID NO: 79408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaaaatttcaagtataag

SEQ ID NO: 79409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattaaaatttcaagtataa

SEQ ID NO: 79410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattaaaatttcaagtata

SEQ ID NO: 79411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttattaaaatttcaagtat

SEQ ID NO: 79412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttattaaaatttcaagt

SEQ ID NO: 79413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataccaacaattcttttt

SEQ ID NO: 79414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaataccaacaattctttt

SEQ ID NO: 79415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaataccaacaattcttt

SEQ ID NO: 79416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttaaaataccaacaat

SEQ ID NO: 79417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattttaaaataccaacaa

SEQ ID NO: 79418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttcaattttaaaatacca

SEQ ID NO: 79419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaatttcaattttaaaata

SEQ ID NO: 79420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgagaatgaaaattgctaa

SEQ ID NO: 79421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgagaatgaaaattgcta

SEQ ID NO: 79422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgagaatgaaaattgct

SEQ ID NO: 79423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatgagaatgaaaattgc

SEQ ID NO: 79424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtttttaatgagaatga

SEQ ID NO: 79425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaagtttttaatgagaatg

SEQ ID NO: 79426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgtgtatgcagacccaaaa

SEQ ID NO: 79427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatgtgtatgcagacccaa

SEQ ID NO: 79428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actctcatgtgtatgcagac

SEQ ID NO: 79429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataattaactctcatgtgta

SEQ ID NO: 79430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctaataattaactctcatgt

SEQ ID NO: 79431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgctaataattaactctca

SEQ ID NO: 79432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgctaataattaactctc

SEQ ID NO: 79433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgctaataattaactct

SEQ ID NO: 79434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcctgctaataattaactc

SEQ ID NO: 79435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcctgctaataattaact

SEQ ID NO: 79436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttttcctgctaataatta

SEQ ID NO: 79437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatcatacctattttttcc

SEQ ID NO: 79438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatcatacctattttttc

SEQ ID NO: 79439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataatcatacctatttttt

SEQ ID NO: 79440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaaattttataatcatacc

SEQ ID NO: 79441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacatgacacagtgatctgc

SEQ ID NO: 79442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggacatgacacagtgatctg

SEQ ID NO: 79443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggacatgacacagtgatct

SEQ ID NO: 79444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggacatgacacagtgatc

SEQ ID NO: 79445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcataacatttttggacatg

SEQ ID NO: 79446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcataacatttttggacat

SEQ ID NO: 79447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttagcataacatttttgga

SEQ ID NO: 79448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtataattgtttagcataac

SEQ ID NO: 79449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtataattgtttagcataa

SEQ ID NO: 79450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttagtataattgtttagca

SEQ ID NO: 79451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtataacatagtatacattg

SEQ ID NO: 79452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtataacatagtatacatt

SEQ ID NO: 79453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtataatgtttagtataaca

SEQ ID NO: 79454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtataatgtttagtataac

SEQ ID NO: 79455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaaatttagtataatgttt

SEQ ID NO: 79456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagcaattgtgaaatttagt

SEQ ID NO: 79457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagcaattgtgaaatttag

SEQ ID NO: 79458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaagcaattgtgaaattta

SEQ ID NO: 79459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgaagcaattgtgaaatt

SEQ ID NO: 79460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttgaagcaattgtgaaa

SEQ ID NO: 79461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctctttgaagcaattgtg

SEQ ID NO: 79462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctctttgaagcaattgt

SEQ ID NO: 79463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattctctttgaagcaattg

SEQ ID NO: 79464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtattttattctctttgaa

SEQ ID NO: 79465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaggtattttattctcttt

SEQ ID NO: 79466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattcctaggtattttattc

SEQ ID NO: 79467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagttggattcctaggtat

SEQ ID NO: 79468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaagttggattcctaggta

SEQ ID NO: 79469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatcccttgtaagttggat

SEQ ID NO: 79470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacatcccttgtaagttgga

SEQ ID NO: 79471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gaagaggtccttcacatccc

SEQ ID NO: 79472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcgaagaggtccttcacat

SEQ ID NO: 79473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctcgaagaggtccttcac

SEQ ID NO: 79474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagttctcctcgaagaggtc

SEQ ID NO: 79475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagttctcctcgaagaggt

SEQ ID NO: 79476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcagtggtttgtagttctc

SEQ ID NO: 79477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagcagtggtttgtagttct

SEQ ID NO: 79478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgagcagtggtttgtagt

SEQ ID NO: 79479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttgagcagtggtttgtag

SEQ ID NO: 79480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttccttgagcagtggtttg

SEQ ID NO: 79481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttccttgagcagtggttt

SEQ ID NO: 79482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttccttgagcagtggtt

SEQ ID NO: 79483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatttccttgagcagtggt

SEQ ID NO: 79484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttatttccttgagcagtg

SEQ ID NO: 79485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatcctcttttatttccttg

SEQ ID NO: 79486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatcctcttttatttcctt

SEQ ID NO: 79487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtatcctcttttatttc

SEQ ID NO: 79488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtatcctcttttattt

SEQ ID NO: 79489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttgtttgtatcctcttt

SEQ ID NO: 79490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatttgtttgtatcctctt

SEQ ID NO: 79491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccatttgtttgtatcctc

SEQ ID NO: 79492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacatgagcatggaatgttc

SEQ ID NO: 79493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctacacatgagcatggaatg

SEQ ID NO: 79494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctacacatgagcatggaat

SEQ ID NO: 79495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcctacacatgagcatgga

SEQ ID NO: 79496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attcttcctacacatgagca

SEQ ID NO: 79497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acgatattgattcttcctac

SEQ ID NO: 79498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacgatattgattcttccta

SEQ ID NO: 79499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacgatattgattcttcct

SEQ ID NO: 79500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggcagtatggccattttcac

SEQ ID NO: 79501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggcagtatggccattttca

SEQ ID NO: 79502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttgggcagtatggccatt

SEQ ID NO: 79503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaattaccttgggcagtat

SEQ ID NO: 79504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatctgtaaattaccttggg

SEQ ID NO: 79505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggggatggcattgaatct

SEQ ID NO: 79506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatggggatggcattgaatc

SEQ ID NO: 79507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtagcttgatggggatggca

SEQ ID NO: 79508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaagaaagtcattggtagc

SEQ ID NO: 79509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgaagaaagtcattggta

SEQ ID NO: 79510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagttctgtgaagaaagtca

SEQ ID NO: 79511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagttctgtgaagaaagtc

SEQ ID NO: 79512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccagttctgtgaagaaagt

SEQ ID NO: 79513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccagttctgtgaagaaag

SEQ ID NO: 79514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccagttctgtgaagaaa

SEQ ID NO: 79515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtagttttttccagttct

SEQ ID NO: 79516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtagttttttccagttc

SEQ ID NO: 79517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaagtagttttttccagtt

SEQ ID NO: 79518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catatgaactttaaagtagt

SEQ ID NO: 79519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttccatatgaactttaaag

SEQ ID NO: 79520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttccatatgaactttaaa

SEQ ID NO: 79521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggttccatatgaactttaa

SEQ ID NO: 79522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggttccatatgaacttta

SEQ ID NO: 79523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttggttccatatgaacttt

SEQ ID NO: 79524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttggttccatatgaactt

SEQ ID NO: 79525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttttggttccatatgaac

SEQ ID NO: 79526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcgatgcgggctcttttttg

SEQ ID NO: 79527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcgatgcgggctctttttt

SEQ ID NO: 79528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acttggcgatgcgggctctt

SEQ ID NO: 79529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggattgacttggcgatgcgg

SEQ ID NO: 79530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggattgacttggcgatgcg

SEQ ID NO: 79531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcttaggattgacttggcga

SEQ ID NO: 79532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcttaggattgacttggcg

SEQ ID NO: 79533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggcttaggattgacttggc

SEQ ID NO: 79534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggcttaggattgacttgg

SEQ ID NO: 79535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttggcttaggattgactt

SEQ ID NO: 79536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcttttggcttaggattga

SEQ ID NO: 79537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttcttttggcttaggattg

SEQ ID NO: 79538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttcttttggcttaggatt

SEQ ID NO: 79539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagctttgttcttttggctt

SEQ ID NO: 79540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtcaggtagcgtgatgcc

SEQ ID NO: 79541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagtcaggtagcgtgatgc

SEQ ID NO: 79542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtgtagtttgaagtcagg

SEQ ID NO: 79543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtagtgtagtttgaagtcag

SEQ ID NO: 79544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagccttgtagtgtagtttg

SEQ ID NO: 79545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtagccttgtagtgtagt

SEQ ID NO: 79546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggttactgtagccttgtagt

SEQ ID NO: 79547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggttactgtagccttgtag

SEQ ID NO: 79548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgggttactgtagccttg

SEQ ID NO: 79549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaccagtaccatgctgttt

SEQ ID NO: 79550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaccagtaccatgctgtt

SEQ ID NO: 79551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtaccagtaccatgctgt

SEQ ID NO: 79552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttggtaccagtaccatgc

SEQ ID NO: 79553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttttggtaccagtaccat

SEQ ID NO: 79554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatctctgttttggtaccag

SEQ ID NO: 79555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atctatatctctgttttggt

SEQ ID NO: 79556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattgatctatatctctgtt

SEQ ID NO: 79557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttccattgatctatatctct

SEQ ID NO: 79558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttccattgatctatatct

SEQ ID NO: 79559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctgttccattgatctata

SEQ ID NO: 79560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttctgttccattgatcta

SEQ ID NO: 79561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agggctctgttctgttccat

SEQ ID NO: 79562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagggctctgttctgttcc

SEQ ID NO: 79563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgagggctctgttctgttc

SEQ ID NO: 79564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctgagggctctgttctg

SEQ ID NO: 79565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagatatgtggcgttatttc

SEQ ID NO: 79566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaaagatcagatagttgta

SEQ ID NO: 79567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcaaagatcagatagttgt

SEQ ID NO: 79568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggtttgtcaaagatcagat

SEQ ID NO: 79569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaggtttgtcaaagatcag

SEQ ID NO: 79570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaggtttgtcaaagatca

SEQ ID NO: 79571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcaggtttgtcaaagatc

SEQ ID NO: 79572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcaggtttgtcaaagat

SEQ ID NO: 79573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttctcaggtttgtcaaa

SEQ ID NO: 79574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttttctcaggtttgtcaa

SEQ ID NO: 79575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgtttttctcaggtttgt

SEQ ID NO: 79576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccattgcttgtttttctca

SEQ ID NO: 79577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccattgcttgtttttctc

SEQ ID NO: 79578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccccattgcttgtttttct

SEQ ID NO: 79579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatagggaatcctttcccca

SEQ ID NO: 79580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaatagggaatcctttcc

SEQ ID NO: 79581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaaatagggaatcctttc

SEQ ID NO: 79582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagcaccatttgttaaata

SEQ ID NO: 79583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccagcaccatttgttaaat

SEQ ID NO: 79584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccagcaccatttgttaaa

SEQ ID NO: 79585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gccagttttcccagcaccat

SEQ ID NO: 79586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catatggctagccagttttc

SEQ ID NO: 79587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacatatggctagccagttt

SEQ ID NO: 79588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacatatggctagccagtt

SEQ ID NO: 79589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctacatatggctagccagt

SEQ ID NO: 79590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctttctacatatggctag

SEQ ID NO: 79591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagctttctacatatggcta

SEQ ID NO: 79592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataaggtgtaaggaaggga

SEQ ID NO: 79593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtataaggtgtaaggaaggg

SEQ ID NO: 79594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtataaggtgtaaggaagg

SEQ ID NO: 79595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtataaggtgtaaggaag

SEQ ID NO: 79596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttttgtataaggtgtaag

SEQ ID NO: 79597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattgatttttgtataaggt

SEQ ID NO: 79598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaattgatttttgtataagg

SEQ ID NO: 79599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atccatcttgaattgatttt

SEQ ID NO: 79600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatccatcttgaattgattt

SEQ ID NO: 79601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatccatcttgaattgatt

SEQ ID NO: 79602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtctttaatccatcttgaa

SEQ ID NO: 79603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtctttaatccatcttga

SEQ ID NO: 79604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgtttaagtctttaatcca

SEQ ID NO: 79605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtctaatgtttaagtcttt

SEQ ID NO: 79606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtctaatgtttaagtctt

SEQ ID NO: 79607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggtctaatgtttaagtct

SEQ ID NO: 79608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggttttaggtctaatgttt

SEQ ID NO: 79609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggttttaggtctaatgtt

SEQ ID NO: 79610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatggttttaggtctaatgt

SEQ ID NO: 79611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatggttttaggtctaatg

SEQ ID NO: 79612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggtttttatggttttaggt

SEQ ID NO: 79613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagggtttttatggttttag

SEQ ID NO: 79614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctagggtttttatggtttta

SEQ ID NO: 79615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctagggtttttatggttt

SEQ ID NO: 79616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctagggtttttatggtt

SEQ ID NO: 79617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttctagggtttttatggt

SEQ ID NO: 79618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggttttcttctagggttttt

SEQ ID NO: 79619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatggtaatgcctgggtttt

SEQ ID NO: 79620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtcctgaatggtaatgcct

SEQ ID NO: 79621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccatgcctatgtcctgaat

SEQ ID NO: 79622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcccatgcctatgtcctgaa

SEQ ID NO: 79623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacatgaagtccttgcccat

SEQ ID NO: 79624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agacatgaagtccttgccca

SEQ ID NO: 79625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagacatgaagtccttgccc

SEQ ID NO: 79626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgttttagacatgaagtcc

SEQ ID NO: 79627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgttttagacatgaagtc

SEQ ID NO: 79628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtgttttagacatgaagt

SEQ ID NO: 79629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggtgttttagacatgaag

SEQ ID NO: 79630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttggtgttttagacatg

SEQ ID NO: 79631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccattgcttttggtgtttta

SEQ ID NO: 79632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgccattgcttttggtgtt

SEQ ID NO: 79633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgccattgcttttggtgt

SEQ ID NO: 79634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgccattgcttttggtg

SEQ ID NO: 79635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgttgccattgcttttggt

SEQ ID NO: 79636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttttgttgccattgcttt

SEQ ID NO: 79637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttttgttgccattgctt

SEQ ID NO: 79638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcttttgttgccattgct

SEQ ID NO: 79639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaattttgtcttttgttgc

SEQ ID NO: 79640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcaattttgtcttttgttg

SEQ ID NO: 79641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatcccatttgtcaattttg

SEQ ID NO: 79642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attagatcccatttgtcaat

SEQ ID NO: 79643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattagatcccatttgtcaa

SEQ ID NO: 79644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttaattagatcccatttg

SEQ ID NO: 79645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttaattagatcccattt

SEQ ID NO: 79646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtttaattagatcccatt

SEQ ID NO: 79647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttagtttaattagatccca

SEQ ID NO: 79648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcagaagctctttagttta

SEQ ID NO: 79649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtgcagaagctctttagt

SEQ ID NO: 79650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgtgcagaagctctttag

SEQ ID NO: 79651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctgtgcagaagctcttta

SEQ ID NO: 79652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgctgtgcagaagctct

SEQ ID NO: 79653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttgctgtgcagaagctc

SEQ ID NO: 79654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggtagtttattttgctgt

SEQ ID NO: 79655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatggtagtttattttgct

SEQ ID NO: 79656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actctgatggtagtttattt

SEQ ID NO: 79657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgttcactctgatggtag

SEQ ID NO: 79658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taggttgcatgttcactctg

SEQ ID NO: 79659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaggttgcatgttcactct

SEQ ID NO: 79660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaggttgcatgttcactc

SEQ ID NO: 79661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccattttgtaggttgcatgt

SEQ ID NO: 79662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctcccattttgtaggttgc

SEQ ID NO: 79663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cgaaaattgtctcccatttt

SEQ ID NO: 79664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagatgagtaggttgcgaa

SEQ ID NO: 79665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcagatgagtaggttgcga

SEQ ID NO: 79666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcagatgagtaggttgcg

SEQ ID NO: 79667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtcagatgagtaggttgc

SEQ ID NO: 79668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccttttgtcagatgagtag

SEQ ID NO: 79669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatattagccttttgtcaga

SEQ ID NO: 79670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggatattagccttttgtca

SEQ ID NO: 79671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagattctggatattagcct

SEQ ID NO: 79672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgtagattctggatatta

SEQ ID NO: 79673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttcattgtagattctgga

SEQ ID NO: 79674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagttcattgtagattctgg

SEQ ID NO: 79675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgagttcattgtagattc

SEQ ID NO: 79676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgagttcattgtagatt

SEQ ID NO: 79677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaatttgtttgagttcatt

SEQ ID NO: 79678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaaatttgtttgagttcat

SEQ ID NO: 79679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtaaatttgtttgagttc

SEQ ID NO: 79680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgtaaatttgtttgagtt

SEQ ID NO: 79681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgtaaatttgtttgagt

SEQ ID NO: 79682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttgtaaatttgtttgag

SEQ ID NO: 79683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttgtaaatttgtttga

SEQ ID NO: 79684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcttgtaaatttgtttg

SEQ ID NO: 79685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttttcttgtaaatttgt

SEQ ID NO: 79686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttttcttgtaaatttg

SEQ ID NO: 79687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtttttttcttgtaaat

SEQ ID NO: 79688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggggttgtttgttttttt

SEQ ID NO: 79689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatggggttgtttgtttttt

SEQ ID NO: 79690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatggggttgtttgttttt

SEQ ID NO: 79691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgatggggttgtttgtttt

SEQ ID NO: 79692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgatggggttgtttgttt

SEQ ID NO: 79693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccactttttgatggggttg

SEQ ID NO: 79694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcccactttttgatggggtt

SEQ ID NO: 79695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcccactttttgatggggt

SEQ ID NO: 79696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtcctttgcccacttttt

SEQ ID NO: 79697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcatgtcctttgcccactt

SEQ ID NO: 79698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaagtgtctgttcatgtcc

SEQ ID NO: 79699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaagtgtctgttcatgtc

SEQ ID NO: 79700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagaagtgtctgttcatgt

SEQ ID NO: 79701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgagaagtgtctgttcatg

SEQ ID NO: 79702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgagaagtgtctgttca

SEQ ID NO: 79703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttgagaagtgtctgttc

SEQ ID NO: 79704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cataaatgtcttcttttgag

SEQ ID NO: 79705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctgcataaatgtcttcttt

SEQ ID NO: 79706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctgcataaatgtcttctt

SEQ ID NO: 79707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggctgcataaatgtcttct

SEQ ID NO: 79708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggctgcataaatgtcttc

SEQ ID NO: 79709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttggctgcataaatgtctt

SEQ ID NO: 79710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtgttttttggctgcata

SEQ ID NO: 79711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgtgttttttggctgcat

SEQ ID NO: 79712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgtgttttttggctgca

SEQ ID NO: 79713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatgtgttttttggctgc

SEQ ID NO: 79714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcatgtgttttttggctg

SEQ ID NO: 79715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggccagtgatgatgagca

SEQ ID NO: 79716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatggccagtgatgatgag

SEQ ID NO: 79717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgatggccagtgatgatg

SEQ ID NO: 79718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctgatggccagtgatgat

SEQ ID NO: 79719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catttctctgatggccagtg

SEQ ID NO: 79720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatttctctgatggccagt

SEQ ID NO: 79721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttgcatttctctgatggc

SEQ ID NO: 79722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttgcatttctctgatgg

SEQ ID NO: 79723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatttgcatttctctgatg

SEQ ID NO: 79724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggttttgatttgcatttct

SEQ ID NO: 79725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgtggttttgatttgcat

SEQ ID NO: 79726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgtgagatggtatctcatt

SEQ ID NO: 79727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actggtgtgagatggtatct

SEQ ID NO: 79728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taactggtgtgagatggtat

SEQ ID NO: 79729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccattctaactggtgtgaga

SEQ ID NO: 79730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgattgccattctaactgg

SEQ ID NO: 79731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgattgccattctaactg

SEQ ID NO: 79732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgattgccattctaact

SEQ ID NO: 79733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatgattgccattctaac

SEQ ID NO: 79734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaatgattgccattctaa

SEQ ID NO: 79735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actttttaatgattgccatt

SEQ ID NO: 79736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgactttttaatgattgcc

SEQ ID NO: 79737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgactttttaatgattgc

SEQ ID NO: 79738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcctgactttttaatgat

SEQ ID NO: 79739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgtttcctgactttttaat

SEQ ID NO: 79740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcacctgttgtttcctga

SEQ ID NO: 79741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccagcacctgttgtttcct

SEQ ID NO: 79742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacatcctctccagcacctg

SEQ ID NO: 79743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccacatcctctccagcacc

SEQ ID NO: 79744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccacatcctctccagcac

SEQ ID NO: 79745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctccacatcctctccag

SEQ ID NO: 79746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatttctccacatcctctc

SEQ ID NO: 79747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaccaacagtgtaaaagtg

SEQ ID NO: 79748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accaccaacagtgtaaaagt

SEQ ID NO: 79749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttaccaccaacagtgtaa

SEQ ID NO: 79750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactagtttaccaccaacag

SEQ ID NO: 79751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacaatggttgaactagttt

SEQ ID NO: 79752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccacaatggttgaactagtt

SEQ ID NO: 79753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acttccacaatggttgaact

SEQ ID NO: 79754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggaatcgccacactgactt

SEQ ID NO: 79755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatccctgaggaatcgccac

SEQ ID NO: 79756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagatccctgaggaatcgcc

SEQ ID NO: 79757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttctagatccctgaggaat

SEQ ID NO: 79758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagttctagatccctgagga

SEQ ID NO: 79759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagttctagatccctgagg

SEQ ID NO: 79760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtcaaatggtatttctagt

SEQ ID NO: 79761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtatatacccagtaatggg

SEQ ID NO: 79762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtatatacccagtaatgg

SEQ ID NO: 79763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggtatatacccagtaatg

SEQ ID NO: 79764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtcctttgggtatatacc

SEQ ID NO: 79765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagtcctttgggtatatac

SEQ ID NO: 79766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagcagcatgatttatagtc

SEQ ID NO: 79767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagcagcatgatttatagt

SEQ ID NO: 79768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatagcagcatgatttatag

SEQ ID NO: 79769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaataatgccacaataaac

SEQ ID NO: 79770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgtgaataatgccacaata

SEQ ID NO: 79771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctattgtgaataatgccaca

SEQ ID NO: 79772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctattgtgaataatgccac

SEQ ID NO: 79773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagtgtttgctattgtgaa

SEQ ID NO: 79774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttccaagtgtttgctattg

SEQ ID NO: 79775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggttggttccaagtgtttgc

SEQ ID NO: 79776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggttggttccaagtgtttg

SEQ ID NO: 79777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacatttgggttggttccaa

SEQ ID NO: 79778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttggacatttgggttggttc

SEQ ID NO: 79779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcattgttggacatttgggt

SEQ ID NO: 79780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atccagtctatcattgttgg

SEQ ID NO: 79781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatccagtctatcattgttg

SEQ ID NO: 79782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaatccagtctatcattgt

SEQ ID NO: 79783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaatccagtctatcattg

SEQ ID NO: 79784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttaatccagtctatcatt

SEQ ID NO: 79785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catggtgtatatgagccaca

SEQ ID NO: 79786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catagtattccatggtgtat

SEQ ID NO: 79787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggctgcatagtattccatg

SEQ ID NO: 79788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggctgcatagtattccat

SEQ ID NO: 79789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatggctgcatagtattcca

SEQ ID NO: 79790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatggctgcatagtattcc

SEQ ID NO: 79791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatggctgcatagtattc

SEQ ID NO: 79792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcattttttatggctgcat

SEQ ID NO: 79793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaggacgtgaactcatca

SEQ ID NO: 79794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catccatgtccctacaaagg

SEQ ID NO: 79795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caattgcatccatgtcccta

SEQ ID NO: 79796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaattgcatccatgtccct

SEQ ID NO: 79797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaatgatgatttccaattg

SEQ ID NO: 79798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgagaatgatgatttccaa

SEQ ID NO: 79799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgagaatgatgatttcca

SEQ ID NO: 79800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatagtttactgagaatga

SEQ ID NO: 79801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgatagtttactgagaatg

SEQ ID NO: 79802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtgatagtttactgagaa

SEQ ID NO: 79803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttgtgatagtttactga

SEQ ID NO: 79804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcttgtgatagtttactg

SEQ ID NO: 79805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattcttgtgatagtttact

SEQ ID NO: 79806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattcttgtgatagtttac

SEQ ID NO: 79807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattcttgtgatagttta

SEQ ID NO: 79808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttttttattcttgtgatag

SEQ ID NO: 79809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttttttattcttgtgata

SEQ ID NO: 79810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgagtgagaatatgcggtgt

SEQ ID NO: 79811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccacctatgagtgagaatat

SEQ ID NO: 79812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattcccacctatgagtgag

SEQ ID NO: 79813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcaattcccacctatgagt

SEQ ID NO: 79814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgttcaattcccacctat

SEQ ID NO: 79815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgttcaattcccaccta

SEQ ID NO: 79816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtccatgtgatttcattgt

SEQ ID NO: 79817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtgtccatgtgatttcat

SEQ ID NO: 79818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgtgtccatgtgatttca

SEQ ID NO: 79819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccttcctgtgtccatgtga

SEQ ID NO: 79820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagtgtgatattccccttcc

SEQ ID NO: 79821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccccaccccaccacagtcc

SEQ ID NO: 79822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccccctccccccaccccacc

SEQ ID NO: 79823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tccctcccccctccccccac

SEQ ID NO: 79824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaatgctatccctcccccc

SEQ ID NO: 79825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtatatctcccaatgctat

SEQ ID NO: 79826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcattaggtatatctcccaa

SEQ ID NO: 79827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcatctagcattaggtata

SEQ ID NO: 79828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actggtcatctagcattagg

SEQ ID NO: 79829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacccactaactggtcatct

SEQ ID NO: 79830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgcgctgcacccactaact

SEQ ID NO: 79831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catatgtatacatgtgccat

SEQ ID NO: 79832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttacatatgtatacatgtg

SEQ ID NO: 79833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcaggttagttacatatgt

SEQ ID NO: 79834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggtacatgtgcacattgtg

SEQ ID NO: 79835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggtacatgtgcacattgt

SEQ ID NO: 79836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagggtacatgtgcacattg

SEQ ID NO: 79837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttttagggtacatgtgca

SEQ ID NO: 79838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagttttagggtacatgtgc

SEQ ID NO: 79839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagttttagggtacatgtg

SEQ ID NO: 79840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactttaagttttagggtac

SEQ ID NO: 79841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attatactttaagttttagg

SEQ ID NO: 79842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattatactttaagttttag

SEQ ID NO: 79843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattatactttaagtttta

SEQ ID NO: 79844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaattatactttaagtttt

SEQ ID NO: 79845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaattatactttaagttt

SEQ ID NO: 79846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaattatactttaagtt

SEQ ID NO: 79847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaattatactttaagt

SEQ ID NO: 79848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttaattatactttaag

SEQ ID NO: 79849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttaattatactttaa

SEQ ID NO: 79850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttaattatacttta

SEQ ID NO: 79851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttttttttaattatac

SEQ ID NO: 79852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttttttttttaattata

SEQ ID NO: 79853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatttttttttttaattat

SEQ ID NO: 79854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaatttttttttttaatta

SEQ ID NO: 79855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttttaatttttttttttaa

SEQ ID NO: 79856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcatactacttttaattttt

SEQ ID NO: 79857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcattggcatactactttta

SEQ ID NO: 79858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggcattggcatactacttt

SEQ ID NO: 79859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctctggcattggcatacta

SEQ ID NO: 79860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaattggctctggcattggc

SEQ ID NO: 79861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgaaattggctctggcat

SEQ ID NO: 79862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgaaattggctctggca

SEQ ID NO: 79863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattgaaattggctctggc

SEQ ID NO: 79864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcattgaaattggctctgg

SEQ ID NO: 79865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatttttcattgaaattgg

SEQ ID NO: 79866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatttttcattgaaattg

SEQ ID NO: 79867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaatttttcattgaaatt

SEQ ID NO: 79868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaaatttttcattgaaat

SEQ ID NO: 79869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcaaatttttcattgaaa

SEQ ID NO: 79870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tactttttcaaatttttcat

SEQ ID NO: 79871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaatctgtactttttcaaa

SEQ ID NO: 79872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatatatatatatatata

SEQ ID NO: 79873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaaatatatatatatat

SEQ ID NO: 79874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgaataaccatatcatgac

SEQ ID NO: 79875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgaataaccatatcatga

SEQ ID NO: 79876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgaaatttagtgaataacc

SEQ ID NO: 79877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agattagtgaaatttagtga

SEQ ID NO: 79878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgagattagtgaaattt

SEQ ID NO: 79879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattgagattagtgaaatt

SEQ ID NO: 79880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaattgagattagtgaaat

SEQ ID NO: 79881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaaattgagattagtga

SEQ ID NO: 79882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tataaaaattattttaaatt

SEQ ID NO: 79883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtataaaaattattttaaa

SEQ ID NO: 79884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgtataaaaattattttaa

SEQ ID NO: 79885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctgtataaaaattattt

SEQ ID NO: 79886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttctgtataaaaattatt

SEQ ID NO: 79887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcttccttctgtataaaaat

SEQ ID NO: 79888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttggcttccttctgtataaa

SEQ ID NO: 79889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttggcttccttctgtata

SEQ ID NO: 79890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgttggcttccttctgtat

SEQ ID NO: 79891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtggtcagtttctgttggc

SEQ ID NO: 79892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtggtcagtttctgttgg

SEQ ID NO: 79893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acttcagtggtcagtttctg

SEQ ID NO: 79894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacttcagtggtcagtttct

SEQ ID NO: 79895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacttcagtggtcagtttc

SEQ ID NO: 79896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgacttcagtggtcagt

SEQ ID NO: 79897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttgacttcagtggtcag

SEQ ID NO: 79898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcagacaaaaaggtgagtt

SEQ ID NO: 79899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctatgcagacaaaaaggtga

SEQ ID NO: 79900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacccctactatgcagacaa

SEQ ID NO: 79901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggacccctactatgcagaca

SEQ ID NO: 79902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaggacttggacccctacta

SEQ ID NO: 79903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccggcatggtgtcagagccc

SEQ ID NO: 79904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcccggcatggtgtcagag

SEQ ID NO: 79905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggggacattcctcccggca

SEQ ID NO: 79906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctatggggacattcctcc

SEQ ID NO: 79907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catctatggggacattcctc

SEQ ID NO: 79908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccttcatctatggggacat

SEQ ID NO: 79909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaaacagctgcccttcatc

SEQ ID NO: 79910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagctggcaaacagctgcc

SEQ ID NO: 79911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaagctggcaaacagctgc

SEQ ID NO: 79912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagaaaatcaaaggaaccc

SEQ ID NO: 79913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgaaagaaaatcaaaggaa

SEQ ID NO: 79914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacaacgcattgctgaaaga

SEQ ID NO: 79915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgaacaacgcattgctga

SEQ ID NO: 79916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccctcattgaacaacgcatt

SEQ ID NO: 79917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccctcattgaacaacgcat

SEQ ID NO: 79918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgccctcattgaacaacgc

SEQ ID NO: 79919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaaaacagtctcttgccct

SEQ ID NO: 79920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacaaaacagtctcttgccc

SEQ ID NO: 79921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccatttcacaaaacagtct

SEQ ID NO: 79922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtccatttcacaaaacagtc

SEQ ID NO: 79923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtccatttcacaaaacagt

SEQ ID NO: 79924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagctttgtccatttcaca

SEQ ID NO: 79925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccccaggacctcagagcttt

SEQ ID NO: 79926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctcccccaggacctcagag

SEQ ID NO: 79927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatatacaggatgaaaaga

SEQ ID NO: 79928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagaggaattaaaatataca

SEQ ID NO: 79929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgaggagctgaagaggaa

SEQ ID NO: 79930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgtgaggagctgaagagga

SEQ ID NO: 79931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttatgtgaggagctgaagag

SEQ ID NO: 79932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catccaggcctcttatgtga

SEQ ID NO: 79933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatccaggcctcttatgtg

SEQ ID NO: 79934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttccatccaggcctcttat

SEQ ID NO: 79935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttccatccaggcctctta

SEQ ID NO: 79936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtttccatccaggcctctt

SEQ ID NO: 79937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgtttccatccaggcctc

SEQ ID NO: 79938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttgtttccatccaggcct

SEQ ID NO: 79939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctttgtttccatccagg

SEQ ID NO: 79940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctttgtttccatccag

SEQ ID NO: 79941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttctttgtttccatcca

SEQ ID NO: 79942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtctttatttctttgtttc

SEQ ID NO: 79943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaggcaaatagttaagtct

SEQ ID NO: 79944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcaggcaaatagttaagtc

SEQ ID NO: 79945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggcaggcaaatagttaag

SEQ ID NO: 79946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttggcaggcaaatagttaa

SEQ ID NO: 79947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttggcaggcaaatagtta

SEQ ID NO: 79948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgggcctttcttggcaggc

SEQ ID NO: 79949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgggcctttcttggcagg

SEQ ID NO: 79950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgggcctttcttggcag

SEQ ID NO: 79951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatgggcctttcttggca

SEQ ID NO: 79952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttttaatgggcctttctt

SEQ ID NO: 79953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagtttttaatgggccttt

SEQ ID NO: 79954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattagtttttaatgggcc

SEQ ID NO: 79955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttattattagtttttaatgg

SEQ ID NO: 79956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttgttattattagttttt

SEQ ID NO: 79957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgttgttattattagtttt

SEQ ID NO: 79958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttatgttgttattattagt

SEQ ID NO: 79959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatctgtttatgttgtta

SEQ ID NO: 79960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaactaaaaatctgtttatg

SEQ ID NO: 79961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagttgaaactaaaaatctg

SEQ ID NO: 79962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagttgaaactaaaaatct

SEQ ID NO: 79963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtagttgaaactaaaaatc

SEQ ID NO: 79964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtagttgaaactaaaaat

SEQ ID NO: 79965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttttgtagttgaaactaa

SEQ ID NO: 79966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaacatgttaccttttgtag

SEQ ID NO: 79967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagaacatgttaccttttgt

SEQ ID NO: 79968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataattctagaacatgttac

SEQ ID NO: 79969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaagctgataattctagaa

SEQ ID NO: 79970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacaagctgataattctaga

SEQ ID NO: 79971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acacatagtaatcccttaac

SEQ ID NO: 79972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctgacacatagtaatccct

SEQ ID NO: 79973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaggcacgaaagataagtc

SEQ ID NO: 79974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtataaagatggttagaag

SEQ ID NO: 79975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagtataaagatggttaga

SEQ ID NO: 79976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgagtataaagatggttag

SEQ ID NO: 79977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatttctgagtataaagat

SEQ ID NO: 79978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaatttctgagtataaaga

SEQ ID NO: 79979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaagcgtaaacttcaaatt

SEQ ID NO: 79980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagctatgaagcgtaaactt

SEQ ID NO: 79981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagctatgaagcgtaaact

SEQ ID NO: 79982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaagctatgaagcgtaaac

SEQ ID NO: 79983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttaaagctatgaagcgta

SEQ ID NO: 79984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actttaaagctatgaagcgt

SEQ ID NO: 79985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactttaaagctatgaagcg

SEQ ID NO: 79986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactttaaagctatgaagc

SEQ ID NO: 79987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttactttaaagctatgaag

SEQ ID NO: 79988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcattttttactttaaagct

SEQ ID NO: 79989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaaaattgtcattttttac

SEQ ID NO: 79990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcagaaaattgtcattttt

SEQ ID NO: 79991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcagaaaattgtcatttt

SEQ ID NO: 79992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaaaatttactcagaaaat

SEQ ID NO: 79993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggaaaatttactcagaaaa

SEQ ID NO: 79994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caccaaaggtaaatatagac

SEQ ID NO: 79995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattgcaccaaaggtaaata

SEQ ID NO: 79996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttgaattgcaccaaaggt

SEQ ID NO: 79997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagaggaaagttgagttga

SEQ ID NO: 79998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagaggaaagttgagttg

SEQ ID NO: 79999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaagaggaaagttgagtt

SEQ ID NO: 80000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaagaggaaagttgagt

SEQ ID NO: 80001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcataaagacttttaaaaga

SEQ ID NO: 80002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaaaggcattatcataaag

SEQ ID NO: 80003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagagtggtgctaccaaagg

SEQ ID NO: 80004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaaaacagcatcaggctgg

SEQ ID NO: 80005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttggtaaaacagcatcagg

SEQ ID NO: 80006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttggtaaaacagcatcag

SEQ ID NO: 80007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataagtttagttggtaaaa

SEQ ID NO: 80008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatattacataagtttagt

SEQ ID NO: 80009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaatattacataagtttag

SEQ ID NO: 80010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtgacagcagaggattta

SEQ ID NO: 80011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgaagtgacagcagaggat

SEQ ID NO: 80012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaacattgttgaagtgaca

SEQ ID NO: 80013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcaagatgttatgaacatt

SEQ ID NO: 80014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctggtcaagatgttatgaac

SEQ ID NO: 80015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctggtcaagatgttatga

SEQ ID NO: 80016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcctggtcaagatgttatg

SEQ ID NO: 80017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtgagatggaatcttctcct

SEQ ID NO: 80018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgtgagatggaatcttctcc

SEQ ID NO: 80019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataagcaaagaaagtggttt

SEQ ID NO: 80020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attgataagcaaagaaagtg

SEQ ID NO: 80021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgattgataagcaaagaaag

SEQ ID NO: 80022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgattgataagcaaagaaa

SEQ ID NO: 80023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttctgattgataagcaaag

SEQ ID NO: 80024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatggatgaggagttgcttc

SEQ ID NO: 80025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatggatgaggagttgctt

SEQ ID NO: 80026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gcggtaacttgaatggatga

SEQ ID NO: 80027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccatctcgcggtaacttgaa

SEQ ID NO: 80028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgccatctcgcggtaactt

SEQ ID NO: 80029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattgctgccatctcgcggt

SEQ ID NO: 80030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgactgaattgctgccatct

SEQ ID NO: 80031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaattgtgactgaattgctg

SEQ ID NO: 80032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagatggagcctaaaattg

SEQ ID NO: 80033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaattaagagatggagccta

SEQ ID NO: 80034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagatgtggtggaaatagca

SEQ ID NO: 80035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgatggaaagaactgcag

SEQ ID NO: 80036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtgatggaaagaactgca

SEQ ID NO: 80037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agacttcagtgatggaaaga

SEQ ID NO: 80038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagacttcagtgatggaaag

SEQ ID NO: 80039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgagaggtttaagacttcag

SEQ ID NO: 80040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atggatgactatgagaggtt

SEQ ID NO: 80041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatggatgactatgagagg

SEQ ID NO: 80042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caactctcatggatgactat

SEQ ID NO: 80043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attccaactctcatggatga

SEQ ID NO: 80044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatgagttgattccaactc

SEQ ID NO: 80045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataggaaattggaatgagtt

SEQ ID NO: 80046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgggaggagggcaatataca

SEQ ID NO: 80047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgggaggagggcaatatac

SEQ ID NO: 80048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgatttgtgggaggagggc

SEQ ID NO: 80049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaacattaatgatttgtggg

SEQ ID NO: 80050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagaacattaatgatttgt

SEQ ID NO: 80051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatgttattagaacattaat

SEQ ID NO: 80052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagatgttattagaacatta

SEQ ID NO: 80053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accattctagatgttattag

SEQ ID NO: 80054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaaggattcaccattctag

SEQ ID NO: 80055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaaaggattcaccattct

SEQ ID NO: 80056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggaaaggattcaccattc

SEQ ID NO: 80057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaatcttctggaaaggatt

SEQ ID NO: 80058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaaaagtaaattgaaaatc

SEQ ID NO: 80059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgggtctgggaaaagtaaa

SEQ ID NO: 80060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatgggtctgggaaaagta

SEQ ID NO: 80061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctgatgggtctgggaaaa

SEQ ID NO: 80062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccatagatagtgattcctct

SEQ ID NO: 80063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagctgccatagatagtgat

SEQ ID NO: 80064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagactatagctgccatag

SEQ ID NO: 80065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataagactatagctgccata

SEQ ID NO: 80066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataagactatagctgccat

SEQ ID NO: 80067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaatacattttataagac

SEQ ID NO: 80068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataaatacattttataaga

SEQ ID NO: 80069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taataaatacattttataag

SEQ ID NO: 80070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaataaatacattttataa

SEQ ID NO: 80071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaataaatacattttata

SEQ ID NO: 80072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttaataaatacatttt

SEQ ID NO: 80073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttttaataaatacattt

SEQ ID NO: 80074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtcttattttttaataaat

SEQ ID NO: 80075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtcttattttttaataaa

SEQ ID NO: 80076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtcttattttttaataa

SEQ ID NO: 80077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaagtcttattttttaata

SEQ ID NO: 80078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacttttaagtcttattttt

SEQ ID NO: 80079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacttttaagtcttatttt

SEQ ID NO: 80080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgggccaaagagtaatttca

SEQ ID NO: 80081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagcctatgggccaaagagt

SEQ ID NO: 80082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtagcctatgggccaaaga

SEQ ID NO: 80083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tccattctgtagcctatggg

SEQ ID NO: 80084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acgctatccattctgtagcc

SEQ ID NO: 80085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctaacgctatccattctgta

SEQ ID NO: 80086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgcctgctaacgctatcca

SEQ ID NO: 80087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgcctgctaacgctatcc

SEQ ID NO: 80088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgcctgctaacgctatc

SEQ ID NO: 80089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcatgcctgctaacgct

SEQ ID NO: 80090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgttattttcatgcctgct

SEQ ID NO: 80091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acggagaggtacaagggcat

SEQ ID NO: 80092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taacggagaggtacaagggc

SEQ ID NO: 80093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagagctctaacggagaggt

SEQ ID NO: 80094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcactcaagagctctaacg

SEQ ID NO: 80095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaatgtgcctggtcactca

SEQ ID NO: 80096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgacaatgtgcctggtcac

SEQ ID NO: 80097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctattgacaatgtgcctgg

SEQ ID NO: 80098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatatcactgcctattga

SEQ ID NO: 80099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaatatcactgcctattg

SEQ ID NO: 80100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaaatatcactgcctatt

SEQ ID NO: 80101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcaaaatatcactgccta

SEQ ID NO: 80102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcaaaatatcactgcct

SEQ ID NO: 80103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggaaaaaaaaaaaagattt

SEQ ID NO: 80104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagctcaggaaaaaaaaaaa

SEQ ID NO: 80105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagctcaggaaaaaaaaaa

SEQ ID NO: 80106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atacttatagctcaggaaaa

SEQ ID NO: 80107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcccagtgttgatacttat

SEQ ID NO: 80108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggcccagtgttgatactta

SEQ ID NO: 80109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggcccagtgttgatactt

SEQ ID NO: 80110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatattttaggcccagtgtt

SEQ ID NO: 80111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actaaatattttaggcccag

SEQ ID NO: 80112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagcatggttcactaaatat

SEQ ID NO: 80113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagcatggttcactaaata

SEQ ID NO: 80114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttacagcatggttcactaa

SEQ ID NO: 80115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatgacagcacgtctgttta

SEQ ID NO: 80116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaatagaacaacaaagcct

SEQ ID NO: 80117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tataaatagaacaacaaagc

SEQ ID NO: 80118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgctctataaatagaacaac

SEQ ID NO: 80119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctgtgctctataaatagaa

SEQ ID NO: 80120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcctgtgctctataaatag

SEQ ID NO: 80121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctctgcctgtgctctataaa

SEQ ID NO: 80122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatctactctgcctgtgctc

SEQ ID NO: 80123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactaaatctactctgcctg

SEQ ID NO: 80124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaattatactaaatctact

SEQ ID NO: 80125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagaattatactaaatctac

SEQ ID NO: 80126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaagaattatactaaatct

SEQ ID NO: 80127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaaatctcttaagaatta

SEQ ID NO: 80128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcattcagaaaatctctta

SEQ ID NO: 80129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcattcagaaaatctctt

SEQ ID NO: 80130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaatcattcagaaaatct

SEQ ID NO: 80131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattatttaatcattcagaa

SEQ ID NO: 80132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataataattatattattta

SEQ ID NO: 80133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaaattaaataataatta

SEQ ID NO: 80134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcagaaaattaaataataa

SEQ ID NO: 80135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attattcagaaaattaaata

SEQ ID NO: 80136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattattcagaaaattaaat

SEQ ID NO: 80137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaattattcagaaaatta

SEQ ID NO: 80138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattatttaattattcagaa

SEQ ID NO: 80139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataataactatattattta

SEQ ID NO: 80140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaaattaaataataacta

SEQ ID NO: 80141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcagaaaattaaataataa

SEQ ID NO: 80142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctattcagaaaattaaataa

SEQ ID NO: 80143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actattcagaaaattaaata

SEQ ID NO: 80144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactattcagaaaattaaat

SEQ ID NO: 80145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttactattcagaaaattaa

SEQ ID NO: 80146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattctttactattcagaaa

SEQ ID NO: 80147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataattatattctttacta

SEQ ID NO: 80148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaaattaaataattatat

SEQ ID NO: 80149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcagaaaattaaataatta

SEQ ID NO: 80150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctattcagaaaattaaataa

SEQ ID NO: 80151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actattcagaaaattaaata

SEQ ID NO: 80152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttactattcagaaaattaa

SEQ ID NO: 80153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattatttactattcagaaa

SEQ ID NO: 80154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataataattatattattta

SEQ ID NO: 80155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaaattacataataatta

SEQ ID NO: 80156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcagaaaattacataataa

SEQ ID NO: 80157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctattcagaaaattacataa

SEQ ID NO: 80158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actattcagaaaattacata

SEQ ID NO: 80159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttactattcagaaaattac

SEQ ID NO: 80160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattatttactattcagaaa

SEQ ID NO: 80161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataataattatattattta

SEQ ID NO: 80162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaaattacataataatta

SEQ ID NO: 80163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcagaaaattacataataa

SEQ ID NO: 80164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctattcagaaaattacataa

SEQ ID NO: 80165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actattcagaaaattacata

SEQ ID NO: 80166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttactattcagaaaattac

SEQ ID NO: 80167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataattatttactattcaga

SEQ ID NO: 80168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaatattaataattattta

SEQ ID NO: 80169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcagaatattaataattat

SEQ ID NO: 80170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attattcagaatattaataa

SEQ ID NO: 80171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattattcagaatattaata

SEQ ID NO: 80172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaattattcagaatatta

SEQ ID NO: 80173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattatttaattattcagaa

SEQ ID NO: 80174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaattatattatttaattat

SEQ ID NO: 80175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaattatattatttaatta

SEQ ID NO: 80176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaaatcttagaattatat

SEQ ID NO: 80177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcgttcagaaaatcttagaa

SEQ ID NO: 80178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcgttcagaaaatcttaga

SEQ ID NO: 80179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttatcgttcagaaaatct

SEQ ID NO: 80180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagcaaatgctaatttatcg

SEQ ID NO: 80181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgaagcaaatgctaatt

SEQ ID NO: 80182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattgaagcaaatgctaat

SEQ ID NO: 80183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaattgaagcaaatgctaa

SEQ ID NO: 80184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgactttaaattgaagcaa

SEQ ID NO: 80185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggggataatgcagctggtga

SEQ ID NO: 80186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaggggataatgcagctgg

SEQ ID NO: 80187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttaggggataatgcagctg

SEQ ID NO: 80188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgttaggggataatgcagc

SEQ ID NO: 80189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttgttaggggataatgca

SEQ ID NO: 80190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actctcttgttaggggataa

SEQ ID NO: 80191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacgaacaggctgactctct

SEQ ID NO: 80192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caacgaacaggctgactctc

SEQ ID NO: 80193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagcttcaacgaacaggct

SEQ ID NO: 80194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaagcttcaacgaacaggc

SEQ ID NO: 80195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttcaaagcttcaacgaac

SEQ ID NO: 80196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaaggagaagtcaatgtct

SEQ ID NO: 80197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagctagaaaggagaagtca

SEQ ID NO: 80198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaagaatatattatagctag

SEQ ID NO: 80199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctagaagaatatattatagc

SEQ ID NO: 80200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactagaagaatatattata

SEQ ID NO: 80201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctactagaagaatatattat

SEQ ID NO: 80202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acagccttctactagaagaa

SEQ ID NO: 80203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatgaaggtctaacagcct

SEQ ID NO: 80204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaatgaaggtctaacagcc

SEQ ID NO: 80205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacaacagatttgcaatgaa

SEQ ID NO: 80206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattaaacaacagatttgca

SEQ ID NO: 80207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataagagtggttacattaaa

SEQ ID NO: 80208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agatcattgataagagtggt

SEQ ID NO: 80209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctaagatcattgataagag

SEQ ID NO: 80210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaagatctagctaagatca

SEQ ID NO: 80211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcagaagatctagctaaga

SEQ ID NO: 80212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccataacataaaaatgcaag

SEQ ID NO: 80213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggaaagaagtcactgcca

SEQ ID NO: 80214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcagacggtaccccatgaga

SEQ ID NO: 80215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagctggcagacggtacccc

SEQ ID NO: 80216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagctggcagacggtaccc

SEQ ID NO: 80217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaaaaaaaggtttgaagct

SEQ ID NO: 80218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaggtgaagaagctggaaa

SEQ ID NO: 80219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatgaaggctgagaggtgaa

SEQ ID NO: 80220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caattgtatgaaggctgaga

SEQ ID NO: 80221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atccacagcaaggccataac

SEQ ID NO: 80222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agccaaagcctaatccacag

SEQ ID NO: 80223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagccaaagcctaatccaca

SEQ ID NO: 80224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttaagccaaagcctaatcc

SEQ ID NO: 80225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttaagccaaagcctaatc

SEQ ID NO: 80226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatagaagatcaaccagcca

SEQ ID NO: 80227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgatctagatagaagatca

SEQ ID NO: 80228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgatctagatagaagatc

SEQ ID NO: 80229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgatctagatagaagat

SEQ ID NO: 80230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaatatagagaaagtttta

SEQ ID NO: 80231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcaaatatagagaaagtt

SEQ ID NO: 80232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgcaaatatagagaaagt

SEQ ID NO: 80233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagtgaacacatgaatgata

SEQ ID NO: 80234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctccagtgaacacatgaatg

SEQ ID NO: 80235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggaaatcaaatgtgctac

SEQ ID NO: 80236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaggaaatcaaatgtgcta

SEQ ID NO: 80237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaaggaaatcaaatgtgc

SEQ ID NO: 80238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaatgcaaaggaaacattc

SEQ ID NO: 80239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccaagttgtgaatgcaaag

SEQ ID NO: 80240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agccaagttgtgaatgcaaa

SEQ ID NO: 80241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtacttagccaagttgtga

SEQ ID NO: 80242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cactaagtacttagccaagt

SEQ ID NO: 80243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcactaagtacttagccaag

SEQ ID NO: 80244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgcactaagtacttagcca

SEQ ID NO: 80245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcctcttgcactaagtact

SEQ ID NO: 80246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagccaagataggccaaaa

SEQ ID NO: 80247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgaggaaggcatgttgaaa

SEQ ID NO: 80248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtgaggaaggcatgttgaa

SEQ ID NO: 80249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcttagtgaggaaggcatg

SEQ ID NO: 80250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaatgattaagcttagtga

SEQ ID NO: 80251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcagaagctagaaatgat

SEQ ID NO: 80252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatcagaagctagaaatga

SEQ ID NO: 80253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatcagaagctagaaatg

SEQ ID NO: 80254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actttaaatcagaagctaga

SEQ ID NO: 80255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcactttaaatcagaagcta

SEQ ID NO: 80256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcactttaaatcagaagct

SEQ ID NO: 80257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cgcatttctcactttaaatc

SEQ ID NO: 80258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtaaaggaagaattgcgc

SEQ ID NO: 80259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgttcaagtaaaggaagaa

SEQ ID NO: 80260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccacccctaatgttcaagta
